United States Patent 12,508,308 (INFLUENZA mRNA VACCINES) - sequence listing, part 5

SEQ ID NO: 23815 - protein, 469 aa, Artificial Sequence
  neuraminidase__InfluenzaA__AGT18771
MNPNQKIITIGSVSLTISTICFFMQIAILITTVTLHFKQYKFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23816 - protein, 469 aa, Artificial Sequence; identical to SEQ ID NO: 22146
  neuraminidase__InfluenzaA__AGT18772

SEQ ID NO: 23817 - protein, 469 aa, Artificial Sequence
  neuraminidase__InfluenzaA__AGT37104
MNPNQKIITIGSVSLTIATICLLMQIAILVTTVTLHFKQYECSSPPNNQVMPCEPTIIERNITKIVYLTNTTIEREACPELAEYRHWSKPQCKIRGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCITGHDKNATASFIYDGRLVDSIGSWSQNILRTQESECVCINGTCTVVMTDGSASGRADTKIMFVEEGKIVHISPLAGSAQHVEECSCYPKYPGVRCVCRDNWKGSNRPIVDINMKDYSIVSSYVCSGLVGDTPRRNDSSSTSYCLNPNNEEGGHGVKGWAFDDGDDVWMGRTISEKLRLGYETFKVIGGWSKPNSKLQINRQVVVDISNRSGYSGIFSVEGKSCINRCFYVELIRGRKQENEVWWTSNSIVVFCGTSGTYGTGSWPDGADINLMPI

SEQ ID NO: 23818 - protein, 469 aa, Artificial Sequence
  neuraminidase__InfluenzaA__AGU69973
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSPLSGSAQHVEECSCYPRYPGVRCVCRDNWKGSNRPIVDINVKDYSIVSSYVRSGLVGDTPRKNDSSSSSHCLDPNNEEGGHGVKGWAFDDGNDVWMGRTISEKSRSGYETFKVIEGWSKPNSKLQINRQVIVDRGNRSGYSGIFSVEGKSCINRCFYVELIRGGKQETEVLWTSNSIVVFCGTSGTYGTGSWPDGADLNLMPI

SEQ ID NO: 23819 - protein, 469 aa, Artificial Sequence
  neuraminidase__InfluenzaA__AGU92648
MNPNQKIITIGSVCMTIGMANLILQIGNIISIWISHSIQLRNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEIICVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23820 - protein, 469 aa, Artificial Sequence
  neuraminidase__InfluenzaA__AGU92670
MNPNQKIITIGSVCMTIGMANLILQIGNIISIWISHSIQLRNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEIICVCRDNWHGSNRPWVSFNQNLEYQIGYICSGIFGDNPRPDDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23821 - protein, 469 aa, Artificial Sequence
  neuraminidase__InfluenzaA__AGU92681
MNPNQKIITIGSVCMTIGMANLILQIGNIISIWISHSIQLRNQSQIETCNQSVITYENNTWVNQTYVNISNTNFAAGQSVVSVKLAGNSSLCPVSGWATYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEIICVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23822 - protein, 469 aa, Artificial Sequence
  neuraminidase__InfluenzaA__AGU92692
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRVGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFIQHPELTGLDCIRPCFWVELIRGRPKENTIWTSGSSISFCGVNSDTVGWSWPDGAELPFTIDK

SEQ ID NO: 23823 - protein, 469 aa, Artificial Sequence; identical to SEQ ID NO: 23822
  neuraminidase__InfluenzaA__AGU92703

SEQ ID NO: 23824 - protein, 469 aa, Artificial Sequence; identical to SEQ ID NO: 23822
  neuraminidase__InfluenzaA__AGU92714

SEQ ID NO: 23825 - protein, 469 aa, Artificial Sequence; identical to SEQ ID NO: 23822
  neuraminidase__InfluenzaA__AGU92725

SEQ ID NO: 23826 - protein, 469 aa, Artificial Sequence; identical to SEQ ID NO: 23822
  neuraminidase__InfluenzaA__AGU92736

SEQ ID NO: 23827 - protein, 469 aa, Artificial Sequence; identical to SEQ ID NO: 23822
  neuraminidase__InfluenzaA__AGU92747

SEQ ID NO: 23828 - protein, 469 aa, Artificial Sequence; identical to SEQ ID NO: 23822
  neuraminidase__InfluenzaA__AGU92758

SEQ ID NO: 23829 - protein, 469 aa, Artificial Sequence; identical to SEQ ID NO: 23819
  neuraminidase__InfluenzaA__AGU92769

SEQ ID NO: 23830 - protein, 469 aa, Artificial Sequence; identical to SEQ ID NO: 23819
  neuraminidase__InfluenzaA__AGU92780

SEQ ID NO: 23831 - protein, 469 aa, Artificial Sequence
  neuraminidase__InfluenzaA__AGU92791
MNPNQKIITIGSVCMTIGMANLILQIGNIISIWISHSIQLRNQSQIETCNQSVITYENNTWVNQTYVNISNTNFAAGQSVVSVKLAGNSSLCPVSGWAIYSKDNSIRIGSKGDVFVIREPFISCSPLECRIFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEIICVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23832 - protein, 469 aa, Artificial Sequence; identical to SEQ ID NO: 23819
  neuraminidase__InfluenzaA__AGU92802

SEQ ID NO: 23833 - protein, 469 aa, Artificial Sequence; identical to SEQ ID NO: 23819
  neuraminidase__InfluenzaA__AGU92813

SEQ ID NO: 23834 - protein, 469 aa, Artificial Sequence; identical to SEQ ID NO: 23819
  neuraminidase__InfluenzaA__AGU92824

SEQ ID NO: 23835 - protein, 469 aa, Artificial Sequence
  neuraminidase__InfluenzaA__AGU92846
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRVGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFAFKYGNGVWIGRTKSISSRNGFEMIWDPNGWTGTDNNFSIKQDIVGINEWSGYSGSFIQHPELTGLDCIRPCFWVELIRGRPKENTIWTSGSSISFCGVNSDTVGWSWPDGAELPFTIDK

SEQ ID NO: 23836 - protein, 469 aa, Artificial Sequence
  neuraminidase__InfluenzaA__AGU92868
MNPNQKIITIGSVCMTIGMANLILQIGNIISIWISHSIQLGNQNQIETCNQSVITYENNTWVNQTYVNISNTNFAAGQSVVSVKFAGNSSLCPVSGWAIYSKDNSVRVGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFIQHPELTGLDCIRPCFWVELIRGRPKENTIWTSGSSISFCGVNSDTVGWSWPDGAELPFTIDK

SEQ ID NO: 23837 - protein, 469 aa, Artificial Sequence
  neuraminidase__InfluenzaA__AGU92890
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRVGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTETDNNFSIKQDIVGINEWSGYSGSFIQHPELTGLDCIRPCFWVELIRGRPKENTIWTSGSSISFCGVNSDTVGWSWPDGAELPFTIDK

SEQ ID NO: 23838 - protein, 469 aa, Artificial Sequence; identical to SEQ ID NO: 23819
  neuraminidase__InfluenzaA__AGU92901

SEQ ID NO: 23839 - protein, 469 aa, Artificial Sequence; identical to SEQ ID NO: 23819
  neuraminidase__InfluenzaA__AGU92912

SEQ ID NO: 23840 - protein, 469 aa, Artificial Sequence; identical to SEQ ID NO: 23819
  neuraminidase__InfluenzaA__AGU92923

SEQ ID NO: 23841 - protein, 469 aa, Artificial Sequence; identical to SEQ ID NO: 23822
  neuraminidase__InfluenzaA__AGU92934

SEQ ID NO: 23842 - protein, 469 aa, Artificial Sequence; identical to SEQ ID NO: 23822
  neuraminidase__InfluenzaA__AGU92945

SEQ ID NO: 23843 - protein, 469 aa, Artificial Sequence; identical to SEQ ID NO: 23822
  neuraminidase__InfluenzaA__AGU92956

SEQ ID NO: 23844 - protein, 469 aa, Artificial Sequence; identical to SEQ ID NO: 23819
  neuraminidase__InfluenzaA__AGU92967

SEQ ID NO: 23845 - protein, 469 aa, Artificial Sequence; identical to SEQ ID NO: 23819
  neuraminidase__InfluenzaA__AGU92978

SEQ ID NO: 23846 - protein, 469 aa, Artificial Sequence
  neuraminidase__InfluenzaA__AGU92989
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRVGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23847 - protein, 469 aa, Artificial Sequence; identical to SEQ ID NO: 23836
  neuraminidase__InfluenzaA__AGU93000

SEQ ID NO: 23848 - protein, 469 aa, Artificial Sequence; identical to SEQ ID NO: 23837
  neuraminidase__InfluenzaA__AGU93011

SEQ ID NO: 23849 - protein, 454 aa, Artificial Sequence; identical to SEQ ID NO: 20390
  neuraminidase__InfluenzaA__AGU93022

SEQ ID NO: 23850 - protein, 469 aa, Artificial Sequence
  neuraminidase__InfluenzaA__AGU93034
MNPTQKIITIGSVCMTIGMANLILQIGNIISIWISHSIQLGNQNQIETCNQSVITYENNTWVNQTYVNISNTNFAAGQSVASVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23851 - protein, 469 aa, Artificial Sequence; identical to SEQ ID NO: 23158
  neuraminidase__InfluenzaA__AGU93045

SEQ ID NO: 23852 - protein, 469 aa, Artificial Sequence; identical to SEQ ID NO: 23819
  neuraminidase__InfluenzaA__AGU93056

SEQ ID NO: 23853 - protein, 469 aa, Artificial Sequence; identical to SEQ ID NO: 22146
  neuraminidase__InfluenzaA__AGV98980

SEQ ID NO: 23854 - protein, 469 aa, Artificial Sequence; identical to SEQ ID NO: 22146
  neuraminidase__InfluenzaA__AGV98993

SEQ ID NO: 23855 - protein, 469 aa, Artificial Sequence; identical to SEQ ID NO: 22146
  neuraminidase__InfluenzaA__AGV99005

SEQ ID NO: 23856 - protein, 469 aa, Artificial Sequence; identical to SEQ ID NO: 22146
  neuraminidase__InfluenzaA__AGV99017

SEQ ID NO: 23857 - protein, 469 aa, Artificial Sequence; identical to SEQ ID NO: 22146
  neuraminidase__InfluenzaA__AGV99040

SEQ ID NO: 23858 - protein, 469 aa, Artificial Sequence
  neuraminidase__InfluenzaA__AGV99052
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSVISSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23859 - protein, 469 aa, Artificial Sequence
  neuraminidase__InfluenzaA__AGV99100
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCVNRCFYVELIRGRKEETEVLWTSNSIVVFCGTSGTYGTGSWPDGADLNLMPI

SEQ ID NO: 23860 - protein, 469 aa, Artificial Sequence; identical to SEQ ID NO: 22146
  neuraminidase__InfluenzaA__AGV99112

SEQ ID NO: 23861 - protein, 469 aa, Artificial Sequence; identical to SEQ ID NO: 22146
  neuraminidase__InfluenzaA__AGV99124

SEQ ID NO: 23862 - protein, 469 aa, Artificial Sequence; identical to SEQ ID NO: 22146
  neuraminidase__InfluenzaA__AGV99136

SEQ ID NO: 23863 - protein, 469 aa, Artificial Sequence; identical to SEQ ID NO: 22146
  neuraminidase__InfluenzaA__AGV99148

SEQ ID NO: 23864 - protein, 469 aa, Artificial Sequence; identical to SEQ ID NO: 22146
  neuraminidase__InfluenzaA__AGV99160

SEQ ID NO: 23865 - protein, 469 aa, Artificial Sequence; identical to SEQ ID NO: 22146
  neuraminidase__InfluenzaA__AGV99172

SEQ ID NO: 23866 - protein, 469 aa, Artificial Sequence; identical to SEQ ID NO: 22146
  neuraminidase__InfluenzaA__AGV99196

SEQ ID NO: 23867 - protein, 469 aa, Artificial Sequence; identical to SEQ ID NO: 22146
  neuraminidase__InfluenzaA__AGV99208

SEQ ID NO: 23868 - protein, 469 aa, Artificial Sequence; identical to SEQ ID NO: 22146
  neuraminidase__InfluenzaA__AGV99959

SEQ ID NO: 23869 - protein, 469 aa, Artificial Sequence; identical to SEQ ID NO: 23357
  neuraminidase__InfluenzaA__AGW00005

SEQ ID NO: 23870 - protein, 469 aa, Artificial Sequence; identical to SEQ ID NO: 22146
  neuraminidase__InfluenzaA__AGW00068

SEQ ID NO: 23871 - protein, 469 aa, Artificial Sequence
  neuraminidase__InfluenzaA__AGW00080
MNPNQKIITIGSVSLTISTICFFMQIAILITTVTLHFKQYEFDSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23872 - protein, 469 aa, Artificial Sequence
  neuraminidase__InfluenzaA__AGW00104
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGEADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23873 - protein, 469 aa, Artificial Sequence; identical to SEQ ID NO: 23871
  neuraminidase__InfluenzaA__AGW00116

SEQ ID NO: 23874 - protein, 469 aa, Artificial Sequence; identical to SEQ ID NO: 23871
  neuraminidase__InfluenzaA__AGW00128

SEQ ID NO: 23875 - protein, 469 aa, Artificial Sequence; identical to SEQ ID NO: 22146
  neuraminidase__InfluenzaA__AGW00140

SEQ ID NO: 23876 - protein, 469 aa, Artificial Sequence; identical to SEQ ID NO: 22146
  neuraminidase__InfluenzaA__AGW00152

SEQ ID NO: 23877 - protein, 469 aa, Artificial Sequence; identical to SEQ ID NO: 23871
  neuraminidase__InfluenzaA__AGW00164

SEQ ID NO: 23878 - protein, 469 aa, Artificial Sequence; identical to SEQ ID NO: 22146
  neuraminidase__InfluenzaA__AGW00176

SEQ ID NO: 23879 - protein, 469 aa, Artificial Sequence; identical to SEQ ID NO: 22146
  neuraminidase__InfluenzaA__AGW00188

SEQ ID NO: 23880 - protein, 469 aa, Artificial Sequence; identical to SEQ ID NO: 22146
  neuraminidase__InfluenzaA__AGW00712

SEQ ID NO: 23881 - protein, 469 aa, Artificial Sequence; identical to SEQ ID NO: 22146
  neuraminidase__InfluenzaA__AGW00724

SEQ ID NO: 23882 - protein, 469 aa, Artificial Sequence
  neuraminidase__InfluenzaA__AGW00736
MNPNQKIITIGSVSLTISTICFFMQIAILITTVTLHFKQYEFNSPPNNQMMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSDPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23883 - protein, 469 aa, Artificial Sequence
  neuraminidase__InfluenzaA__AGW00748
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23884 - protein, 469 aa, Artificial Sequence
  neuraminidase__InfluenzaA__AGW00760
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQVNRQVIVDRGDRSGYSGIFSVEGKSCINRCFYVELIRGRKEETEVLWTSNSIVVFCGTSGTYGTGSWPDGADLNLMPI

SEQ ID NO: 23885 - protein, 469 aa, Artificial Sequence; identical to SEQ ID NO: 22146
  neuraminidase__InfluenzaA__AGW00784

SEQ ID NO: 23886 - protein, 469 aa, Artificial Sequence; identical to SEQ ID NO: 22146
  neuraminidase__InfluenzaA__AGW00796

SEQ ID NO: 23887 - protein, 469 aa, Artificial Sequence; identical to SEQ ID NO: 23871
  neuraminidase__InfluenzaA__AGW00808

SEQ ID NO: 23888 - protein, 469 aa, Artificial Sequence; identical to SEQ ID NO: 23375
  neuraminidase__InfluenzaA__AGW00820

SEQ ID NO: 23889 - protein, 469 aa, Artificial Sequence; identical to SEQ ID NO: 22146
  neuraminidase__InfluenzaA__AGW00832

SEQ ID NO: 23890 - protein, 469 aa, Artificial Sequence
  neuraminidase__InfluenzaA__AGW00844
MNPNQKIITIGSVSLTISTICFFMQIAILITTVTLHFKQYEFNFPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23891 - protein, 469 aa, Artificial Sequence; identical to SEQ ID NO: 23883
  neuraminidase__InfluenzaA__AGW00868

SEQ ID NO: 23892 - protein, 469 aa, Artificial Sequence
  neuraminidase__InfluenzaA__AGW00880
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDVWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPDVRCVCRDNWKGSNRPIVDINIKDHSIVSRYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23893 - protein, 469 aa, Artificial Sequence
  neuraminidase__InfluenzaA__AGW00892
MNPNQKIITIGSVSLTISTICFFMQIAILITTVTLHFKQYEFNPPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQMNRQVIVDRGDRSGYSGIFSVEGKSCINRCFYVELIRGRKEETEVLWTSNSIVVFCGTSGTYGTGSWPDGADLNLMPI

SEQ ID NO: 23894 - protein, 469 aa, Artificial Sequence
  neuraminidase__InfluenzaA__AGW00904
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCGPDKCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23895 - protein, 469 aa, Artificial Sequence
  neuraminidase__InfluenzaA__AGW00916
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNMHSNNTVCDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23896 - protein, 469 aa, Artificial Sequence; identical to SEQ ID NO: 23871
  neuraminidase__InfluenzaA__AGW00934

SEQ ID NO: 23897 - protein, 469 aa, Artificial Sequence
  neuraminidase__InfluenzaA__AGW01247
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKKDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23898 - protein, 469 aa, Artificial Sequence; identical to SEQ ID NO: 22146
  neuraminidase__InfluenzaA__AGW01259

SEQ ID NO: 23899 - protein, 469 aa, Artificial Sequence; identical to SEQ ID NO: 23883
  neuraminidase__InfluenzaA__AGW01298

SEQ ID NO: 23900 - protein, 469 aa, Artificial Sequence; identical to SEQ ID NO: 23375
  neuraminidase__InfluenzaA__AGW01322

SEQ ID NO: 23901 - protein, 469 aa, Artificial Sequence
  neuraminidase__InfluenzaA__AGW01334
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEEAEVLWTSNSIVVFCGTSGTYGTGSWPDGADLNLMPI

SEQ ID NO: 23902 - protein, 469 aa, Artificial Sequence; identical to SEQ ID NO: 22146
  neuraminidase__InfluenzaA__AGW01346

SEQ ID NO: 23903 - protein, 469 aa, Artificial Sequence
  neuraminidase__InfluenzaA__AGW01358
MNPNQKIITIGSVSLTISTICFFMQIAILITTVTLHFKQYEFNSPPNNQVMLCEPTIIERNITEIVYLTNTTIEKEICPKPTEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23904 - protein, 469 aa, Artificial Sequence; identical to SEQ ID NO: 22146
  neuraminidase__InfluenzaA__AGW01370

SEQ ID NO: 23905 - protein, 469 aa, Artificial Sequence; identical to SEQ ID NO: 22146
  neuraminidase__InfluenzaA__AGW01382

SEQ ID NO: 23906 - protein, 469 aa, Artificial Sequence
  neuraminidase__InfluenzaA__AGW01394
MNPNQKIITIGSVSLTISTICFFMQIAILITTVTLHFKQYEFDSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSIVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23907 - protein, 469 aa, Artificial Sequence
  neuraminidase__InfluenzaA__AGW01406
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVITDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23908 - protein, 469 aa, Artificial Sequence
  neuraminidase__InfluenzaA__AGW01418
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETGVLWTSNSIVVFCGTSGTYGTGSWPDGADLNLMPI

SEQ ID NO: 23909 - protein, 469 aa, Artificial Sequence; identical to SEQ ID NO: 22146
  neuraminidase__InfluenzaA__AGW01430

SEQ ID NO: 23910 - protein, 469 aa, Artificial Sequence; identical to SEQ ID NO: 22146
  neuraminidase__InfluenzaA__AGW01442

SEQ ID NO: 23911 - protein, 469 aa, Artificial Sequence; identical to SEQ ID NO: 22146
  neuraminidase__InfluenzaA__AGW01454

SEQ ID NO: 23912 - protein, 469 aa, Artificial Sequence; identical to SEQ ID NO: 23871
  neuraminidase__InfluenzaA__AGW01466

SEQ ID NO: 23913 - protein, 469 aa, Artificial Sequence; identical to SEQ ID NO: 22146
  neuraminidase__InfluenzaA__AGW01478

SEQ ID NO: 23914 - protein, 469 aa, Artificial Sequence
  neuraminidase__InfluenzaA__AGW01490
MNPNQKIITISSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNSKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23915 - protein, 469 aa, Artificial Sequence; identical to SEQ ID NO: 22146
  neuraminidase__InfluenzaA__AGW01538

SEQ ID NO: 23916 - protein, 469 aa, Artificial Sequence; identical to SEQ ID NO: 23871
  neuraminidase__InfluenzaA__AGW01562

SEQ ID NO: 23917 - protein, 469 aa, Artificial Sequence; identical to SEQ ID NO: 22146
  neuraminidase__InfluenzaA__AGW01574

SEQ ID NO: 23918 - protein, 469 aa, Artificial Sequence; identical to SEQ ID NO: 22146
  neuraminidase__InfluenzaA__AGW01586

SEQ ID NO: 23919 - protein, 469 aa, Artificial Sequence; identical to SEQ ID NO: 22146
  neuraminidase__InfluenzaA__AGW01598

SEQ ID NO: 23920 - protein, 469 aa, Artificial Sequence; identical to SEQ ID NO: 23871
  neuraminidase__InfluenzaA__AGW01610

SEQ ID NO: 23921 - protein, 469 aa, Artificial Sequence; identical to SEQ ID NO: 22146
  neuraminidase__InfluenzaA__AGW01622

SEQ ID NO: 23922 - protein, 469 aa, Artificial Sequence; identical to SEQ ID NO: 22146
  neuraminidase__InfluenzaA__AGW01634

SEQ ID NO: 23923 - protein, 469 aa, Artificial Sequence
  neuraminidase__InfluenzaA__AGW01646
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCIDGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23924 - protein, 469 aa, Artificial Sequence; identical to SEQ ID NO: 22146
  neuraminidase__InfluenzaA__AGW01670

SEQ ID NO: 23925 - protein, 469 aa, Artificial Sequence; identical to SEQ ID NO: 22146
  neuraminidase__InfluenzaA__AGW01682

SEQ ID NO: 23926 - protein, 469 aa, Artificial Sequence; identical to SEQ ID NO: 23883
  neuraminidase__InfluenzaA__AGW01704

SEQ ID NO: 23927 - protein, 469 aa, Artificial Sequence
  neuraminidase__InfluenzaA__AGW01716
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGRSCINRCFYVELIRGRKEETEVLWTSNSIVVFCGTSGTYGTGSWPDGADLNLMPI

SEQ ID NO: 23928 - protein, 469 aa, Artificial Sequence
  neuraminidase__InfluenzaA__AGW01728
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSVVVFCGTSGTYGTGSWPDGADLNLMPI

SEQ ID NO: 23929 - protein, 469 aa, Artificial Sequence; identical to SEQ ID NO: 22146
  neuraminidase__InfluenzaA__AGW01740

SEQ ID NO: 23930 - protein, 469 aa, Artificial Sequence
  neuraminidase__InfluenzaA__AGW01752
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIGGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23931 - protein, 469 aa, Artificial Sequence; identical to SEQ ID NO: 22146
  neuraminidase__InfluenzaA__AGW01764

SEQ ID NO: 23932 - protein, 469 aa, Artificial Sequence; identical to SEQ ID NO: 23883
  neuraminidase__InfluenzaA__AGW01776

SEQ ID NO: 23933 - protein, 469 aa, Artificial Sequence; identical to SEQ ID NO: 23871
  neuraminidase__InfluenzaA__AGW01788

SEQ ID NO: 23934 - protein, 469 aa, Artificial Sequence; identical to SEQ ID NO: 23883
  neuraminidase__InfluenzaA__AGW01800

SEQ ID NO: 23935 - protein, 469 aa, Artificial Sequence; identical to SEQ ID NO: 23871
  neuraminidase__InfluenzaA__AGW01812

SEQ ID NO: 23936 - protein, 469 aa, Artificial Sequence; identical to SEQ ID NO: 23871
  neuraminidase__InfluenzaA__AGW01824

SEQ ID NO: 23937 - protein, 469 aa, Artificial Sequence; identical to SEQ ID NO: 23894
  neuraminidase__InfluenzaA__AGW01848

SEQ ID NO: 23938 - protein, 469 aa, Artificial Sequence
  neuraminidase__InfluenzaA__AGW01860
MNPNQKIITIGSVSLTISTICFFMQIAILITTVTLHFKQYEFNSLPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCFDPNNEEGGHGVKGWAFDDGNDVWMGRTINETSRLGYETFKVIGGWSNPKSKLQINRQVIVDRGDRSGYSGIFSVEGKSCINRCFYVELIRGRKEETEVLWTSNSIIVFCGTSGTYGTGSWPDGADLNLMPI

SEQ ID NO: 23939 - protein, 469 aa, Artificial Sequence
  neuraminidase__InfluenzaA__AGW01884
MNPNQKIITIGSVSLTISTICFFMQIAILITTVTLHFKQYEFNSPPNNQVMLCEPTIIERNITKIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23940 - protein, 469 aa, Artificial Sequence; identical to SEQ ID NO: 22146
  neuraminidase__InfluenzaA__AGW01896

SEQ ID NO: 23941 - protein, 469 aa, Artificial Sequence; identical to SEQ ID NO: 22146
  neuraminidase__InfluenzaA__AGW01908

SEQ ID NO: 23942 - protein, 469 aa, Artificial Sequence; identical to SEQ ID NO: 22146
  neuraminidase__InfluenzaA__AGW01920

SEQ ID NO: 23943 - protein, 469 aa, Artificial Sequence; identical to SEQ ID NO: 22146
  neuraminidase__InfluenzaA__AGW01932

SEQ ID NO: 23944 - protein, 469 aa, Artificial Sequence
  neuraminidase__InfluenzaA__AGW01944
MNPNQKIITIGSVSLTISTICFFMQIAILITTVTLHFKQYEFNFPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLAPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23945 - protein, 469 aa, Artificial Sequence; identical to SEQ ID NO: 22146
  neuraminidase__InfluenzaA__AGW01956

SEQ ID NO: 23946 - protein, 469 aa, Artificial Sequence
  neuraminidase__InfluenzaA__AGW01968
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTIRDRTPYRTLLMNELGVPFHLGTKQVCIAWSSSSCHDGKAWLHVCITGDDENATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSRYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23947 - protein, 469 aa, Artificial Sequence; identical to SEQ ID NO: 23871
  neuraminidase__InfluenzaA__AGW01980

SEQ ID NO: 23948 - protein, 469 aa, Artificial Sequence; identical to SEQ ID NO: 22146
  neuraminidase__InfluenzaA__AGW01992

SEQ ID NO: 23949 - protein, 469 aa, Artificial Sequence; identical to SEQ ID NO: 22146
  neuraminidase__InfluenzaA__AGW02004

SEQ ID NO: 23950 - protein, 469 aa, Artificial Sequence; identical to SEQ ID NO: 22146
  neuraminidase__InfluenzaA__AGW02016

SEQ ID NO: 23951 - protein, 469 aa, Artificial Sequence; identical to SEQ ID NO: 22146
  neuraminidase__InfluenzaA__AGW02040

SEQ ID NO: 23952 - protein, 469 aa, Artificial Sequence
  neuraminidase__InfluenzaA__AGW02064
MNPNQKIITIGSVSLTISTICFFMQIAILITTVTLHFKQYEFDSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSGHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23953 - protein, 469 aa, Artificial Sequence; identical to SEQ ID NO: 22146
  neuraminidase__InfluenzaA__AGW02076

SEQ ID NO: 23954 - protein, 469 aa, Artificial Sequence; identical to SEQ ID NO: 22146
  neuraminidase__InfluenzaA__AGW02088

SEQ ID NO: 23955 - protein, 469 aa, Artificial Sequence
  neuraminidase__InfluenzaA__AGW02100
MNPNQKIITIGSVSLTISTICFFMQIAILITTVTLHFKQYESNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23956 - protein, 469 aa, Artificial Sequence; identical to SEQ ID NO: 23883
  neuraminidase__InfluenzaA__AGW02112

SEQ ID NO: 23957 - protein, 469 aa, Artificial Sequence
  neuraminidase__InfluenzaA__AGW02124
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVSDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23958 - protein, 469 aa, Artificial Sequence; identical to SEQ ID NO: 23871
  neuraminidase__InfluenzaA__AGW02136

SEQ ID NO: 23959 - protein, 469 aa, Artificial Sequence; identical to SEQ ID NO: 23883
  neuraminidase__InfluenzaA__AGW02148

SEQ ID NO: 23960 - protein, 469 aa, Artificial Sequence
  neuraminidase__InfluenzaA__AGW02160
MNPNQKIITIGSVSLTISTICFFMQIAILITTVTLHFKQYEFDSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRSDRSGYSGIFSVEGKSCINRCFYVELIRGRKEETEVLWTSNSIVVFCGTSGTYGTGSWPDGADLNLMPI

SEQ ID NO: 23961 - protein, 469 aa, Artificial Sequence; identical to SEQ ID NO: 22146
  neuraminidase__InfluenzaA__AGW02172

SEQ ID NO: 23962 - protein, 469 aa, Artificial Sequence; identical to SEQ ID NO: 22146
  neuraminidase__InfluenzaA__AGW02184

SEQ ID NO: 23963 - protein, 469 aa, Artificial Sequence
  neuraminidase__InfluenzaA__AGW02196
MNPNQKIITIGSVSLTISTICFFMQIAILITTVTLHFKQYEFNSPPNNQVMLCEPTIIERNITEIVYLINTTIEKEICPKPAEYRNWSKPQCGITGFAPFSKDNSIRLSAGGDIWVTREPYVSCDPYKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23964 - protein, 469 aa, Artificial Sequence; identical to SEQ ID NO: 23375
  neuraminidase__InfluenzaA__AGW04174

SEQ ID NO: 23965 - protein, 469 aa, Artificial Sequence
  neuraminidase__InfluenzaA__AGW25784
MNPNQKIITIGSVSLIIATICFLMQIAILVTTVTLHFKQYGYNSLPNNQVMLCEPTIIERNITEIVYLTNTTIEKEICPKLAEYRNWSKPQCKITGFAPFSKDNSIRLSAGGDIWVTREPYVSCDPYKCYQFALGQGTTLNNKHSNDTVHDRTPYRTLLMNELGVPFHLGTKQVCIAWSSSSCHDGKAWLHICVTGHDENATASFIYDGKLVDSIGSWSKKILRTQESECVCINGTCTVVMTDGSASGRADTKILFIEEGKIIHISQLSGSAQHVEECSCYPRYPGIRCVCRDNWKGSNRPIVDINVKDYSITSSYVCSGLVGDTPRKTDNSSSSHCLNPNNEEGGHGVKGWAFDDGNDVWMGRTISEKFRSGYETFKVIKGWSKPNSKLQINRQVIVDRDNRSGYSGIFSVEGKSCINRCFYVELIRGRKREAEVWWTSNSIVVFCGTSGTYGTGSWPDGADINLMPI

SEQ ID NO: 23966 - protein, 449 aa, Artificial Sequence
  neuraminidase__InfluenzaA__AGW27062
MNPNQKIVTIGSICMVIGTISLMLQIGNIISIWVSHSIQTGNQHQTEPIRNTNFLTENAVASVTLAGNSSLCPIRGWAVHSKDNSIRIGSKGDVFVIREPFISCSHLECRTFFLTQGALLNDKHSNGTVKDRSPHRTLMSCPIGEAPSPYNSRFESVAWSASACHDGTSWLVIGISGPDNGAVAVLKYNGIITDTIRSWRNNILRTQESECACVNGSCFTVMTDGPSNGQASYKIFKIEKGKVVKSVELNAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTHSRSGFEMIWDPNGWTGTDSEFSMKQDIVAITDWSGYSGSFVQHPELTGLDCIRPCFWVELIRGRPKESTIWTSGSSISFCGVNSDTVSWSWPDGAELPFTIDK

SEQ ID NO: 23967 - protein, 469 aa, Artificial Sequence
  neuraminidase__InfluenzaA__AGY14472
MNPNQKIITIGSVSLTLATICFLMQIAILVTTVTLHFKQYECNSTPNNQVMLCEPTVIERNITKIVYLTNTTVEKEICPKPAEYRNWSKPQCKITGFAPFSKDNSIRLSAGGDIWVTREPYVSCDPNKCYQFALGQGTTLNNRHSNDTVHDRTPYRTLLMNELGIPFHLGTKQVCIAWSSSSCHDGKAWLHVCVTGHDKNATASFIYDGKLVDSIGSWSKKILRTQESECVCINGTCTVVMTDGSASGRADTKILFIEEGKIIHISQLSGSAQHVEECSCYPRYPGIRCVCRDNWKGSNRPIVDINVKDYSITSSYVCSGLVGDTPRKTDNSSSSHCLNPNNEEGGHGVKGWAFDDGNDVWMGRTISEKFRSGYETFKVIKGWSKPNSKLQINRQVIVDRDNRSGYSGIFSVEGKSCINRCFYVELIRGRKREAEVWWTSNSIVVFCGTSGTYGTGSWPDGADINLMPI

SEQ ID NO: 23968 - protein, 465 aa, Artificial Sequence
  neuraminidase__InfluenzaA__AHA11501
MNPNQKILCTSATAIIIGAIAVLIGIANLGLNIGLHLKPGCNCSHSQPETTNTSQTIINNYYNETNITNIQMEERTSRNFNNLTKGLCTINSWHIYGKDNAVRIGESSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPIVFTDGSATGPADTRIYYFKEGKILEWESLTGTAKHIEECSCYGERTGITCTCRDNWQGSNRPVIQIDPVAMTHTSQYICSPVLTDTPRPNDPNIGKCNDPYPGNDNNGVKGFSYLDGANTWLGRTISTASRSGYEMLKVPNALTDDRSKPIQGQTIVLNADWSGYSGSFMDYWAEGDCYRACFYVELIRGRPKEDKVWWTSNSIVSMCSSTEFLGQWNWPDGARIEYFL

SEQ ID NO: 23969 - protein, 469 aa, Artificial Sequence
  neuraminidase__InfluenzaA__AHC57462
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCWDPNNEEGGHGVKGWAFDDGNDVWMGRTINETSRLGYETFKVIEGWSNPKSKLQVNRQVIVDRGDRSGYSGIFSVEGKSCINRCFYVELIRGRKEETEVLWTSNSIVVFCGTSGTYGTGSWPDGADLNLMPI

SEQ ID NO: 23970 - protein, 469 aa, Artificial Sequence; identical to SEQ ID NO: 19518
  neuraminidase__InfluenzaA__AHC57490

SEQ ID NO: 23971 - protein, 469 aa, Artificial Sequence
  neuraminidase__InfluenzaA__AHC57514
MNPNQKIITIGSVSLTISTICFFMQIAILITTVTLHFKQYEFYSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 23972 - protein, 469 aa, Artificial Sequence; identical to SEQ ID NO: 23971
  neuraminidase__InfluenzaA__AHC57526

SEQ ID NO: 23973 - protein, 469 aa, Artificial Sequence; identical to SEQ ID NO: 23971
  neuraminidase__InfluenzaA__AHC57806

SEQ ID NO: 23974 - protein, 469 aa, Artificial Sequence; identical to SEQ ID NO: 23971
  neuraminidase__InfluenzaA__AHC57818

SEQ ID NO: 23975 - protein, 469 aa, Artificial Sequence
  neuraminidase__InfluenzaA__AHC57830
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 23976 - protein, 469 aa, Artificial Sequence; identical to SEQ ID NO: 23975
  neuraminidase__InfluenzaA__AHC57971

SEQ ID NO: 23977 - protein, 469 aa, Artificial Sequence; identical to SEQ ID NO: 23971
  neuraminidase__InfluenzaA__AHC57984

SEQ ID NO: 23978 - protein, 469 aa, Artificial Sequence
  neuraminidase__InfluenzaA__AHC57996
MNPNQKIITIGSVSLTISTICFFMQIAILITTVTLHFKQYEFYSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPHRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 23979 - protein, 469 aa, Artificial Sequence; identical to SEQ ID NO: 22922
  neuraminidase__InfluenzaA__AHC58008

SEQ ID NO: 23980 - protein, 469 aa, Artificial Sequence; identical to SEQ ID NO: 19518
  neuraminidase__InfluenzaA__AHC58020

SEQ ID NO: 23981 - protein, 469 aa, Artificial Sequence
  neuraminidase__InfluenzaA__AHC58032
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLNPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 23982 - protein, 469 aa, Artificial Sequence; identical to SEQ ID NO: 22922
  neuraminidase__InfluenzaA__AHC58053

SEQ ID NO: 23983 - protein, 469 aa, Artificial Sequence
  neuraminidase__InfluenzaA__AHC58077
MNPNQKIITIGSVSLTISTICFFMQIAILITTVTLHFKQYEFYSPPNNQVMLREPTIIERNITEIVYLTNTTTEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 23984 - protein, 469 aa, Artificial Sequence; identical to SEQ ID NO: 23975
  neuraminidase__InfluenzaA__AHC58089

SEQ ID NO: 23985 - protein, 469 aa, Artificial Sequence; identical to SEQ ID NO: 23971
  neuraminidase__InfluenzaA__AHC58101

SEQ ID NO: 23986 - protein, 469 aa, Artificial Sequence
  neuraminidase__InfluenzaA__AHC58113
MNPNQKIITIGSVSLTISTICFFMQIAILITTVTLHFKQYEFYSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKKILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 23987 - protein, 469 aa, Artificial Sequence; identical to SEQ ID NO: 23971
  neuraminidase__InfluenzaA__AHC58129

SEQ ID NO: 23988 - protein, 469 aa, Artificial Sequence; identical to SEQ ID NO: 23971
  neuraminidase__InfluenzaA__AHC58153

SEQ ID NO: 23989 - protein, 469 aa, Artificial Sequence; identical to SEQ ID NO: 23971
  neuraminidase__InfluenzaA__AHC58165

SEQ ID NO: 23990 - protein, 469 aa, Artificial Sequence; identical to SEQ ID NO: 23975
  neuraminidase__InfluenzaA__AHC58177

SEQ ID NO: 23991 - protein, 469 aa, Artificial Sequence
  neuraminidase__InfluenzaA__AHC58189
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINEMSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23992 - protein, 469 aa, Artificial Sequence; identical to SEQ ID NO: 23971
  neuraminidase__InfluenzaA__AHC58201

SEQ ID NO: 23993 - protein, 469 aa, Artificial Sequence
  neuraminidase__InfluenzaA__AHC58225
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVNRGDRSGYSGIFSVEGKSCINRCFYVELIRGRKEETEVLWTSNSIVVFCGTSGTYGTGSWPDGADLNLMPI

SEQ ID NO: 23994 - protein, 469 aa, Artificial Sequence; identical to SEQ ID NO: 23975
  neuraminidase__InfluenzaA__AHC58237

SEQ ID NO: 23995 - protein, 469 aa, Artificial Sequence; identical to SEQ ID NO: 23971
  neuraminidase__InfluenzaA__AHC58249

SEQ ID NO: 23996 - protein, 469 aa, Artificial Sequence; identical to SEQ ID NO: 19518
  neuraminidase__InfluenzaA__AHC58273

SEQ ID NO: 23997 - protein, 469 aa, Artificial Sequence; identical to SEQ ID NO: 23975
  neuraminidase__InfluenzaA__AHC58363

SEQ ID NO: 23998 - protein, 469 aa, Artificial Sequence; identical to SEQ ID NO: 22922
  neuraminidase__InfluenzaA__AHC58375

SEQ ID NO: 23999 - protein, 469 aa, Artificial Sequence; identical to SEQ ID NO: 23975
  neuraminidase__InfluenzaA__AHC58387

SEQ ID NO: 24000 - protein, 469 aa, Artificial Sequence; identical to SEQ ID NO: 23975
  neuraminidase__InfluenzaA__AHC58399

SEQ ID NO: 24001 - protein, 469 aa, Artificial Sequence; identical to SEQ ID NO: 23971
  neuraminidase__InfluenzaA__AHC58411

SEQ ID NO: 24002 - protein, 469 aa, Artificial Sequence; identical to SEQ ID NO: 22922
  neuraminidase__InfluenzaA__AHC58423

SEQ ID NO: 24003 - protein, 469 aa, Artificial Sequence; identical to SEQ ID NO: 23975
  neuraminidase__InfluenzaA__AHC58459

SEQ ID NO: 24004 - protein, 469 aa, Artificial Sequence
  neuraminidase__InfluenzaA__AHC58471
MNPNQKIITIGSVCMTIGMANLILQIGNIISIWISHSIQLGNQNQIETCNQSVITYENNTWVNQTYVNISNTNFAAGQPVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGANRPWVSFNQNLEYQIGYICSGVFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 24005 - protein, 469 aa, Artificial Sequence; identical to SEQ ID NO: 23971
  neuraminidase__InfluenzaA__AHC58482

SEQ ID NO: 24006 - protein, 469 aa, Artificial Sequence; identical to SEQ ID NO: 23975
  neuraminidase__InfluenzaA__AHC58494

SEQ ID NO: 24007 - protein, 469 aa, Artificial Sequence
  neuraminidase__InfluenzaA__AHC58518
MNPNQKIITIGSVSLTISTICFFMQVAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24008 - protein, 469 aa, Artificial Sequence; identical to SEQ ID NO: 23971
  neuraminidase__InfluenzaA__AHC58530

SEQ ID NO: 24009 - protein, 469 aa, Artificial Sequence; identical to SEQ ID NO: 23971
  neuraminidase__InfluenzaA__AHC58554

SEQ ID NO: 24010 - protein, 469 aa, Artificial Sequence; identical to SEQ ID NO: 23971
  neuraminidase__InfluenzaA__AHC58566

SEQ ID NO: 24011 - protein, 469 aa, Artificial Sequence
  neuraminidase__InfluenzaA__AHC58578
MNPNQKIITIGSVSLTVSTICFFMQIAILITTVTLHFKQYEFYSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24012 - protein, 469 aa, Artificial Sequence; identical to SEQ ID NO: 19518
  neuraminidase__InfluenzaA__AHC58590

SEQ ID NO: 24013 - protein, 469 aa, Artificial Sequence; identical to SEQ ID NO: 24007
  neuraminidase__InfluenzaA__AHC58602

SEQ ID NO: 24014 - protein, 469 aa, Artificial Sequence; identical to SEQ ID NO: 23971
  neuraminidase__InfluenzaA__AHC58614

SEQ ID NO: 24015 - protein, 469 aa, Artificial Sequence; identical to SEQ ID NO: 23971
  neuraminidase__InfluenzaA__AHC58626

SEQ ID NO: 24016 - protein, 469 aa, Artificial Sequence; identical to SEQ ID NO: 23971
  neuraminidase__InfluenzaA__AHC58638

SEQ ID NO: 24017 - protein, 469 aa, Artificial Sequence; identical to SEQ ID NO: 23971
  neuraminidase__InfluenzaA__AHC58650

SEQ ID NO: 24018 - protein, 469 aa, Artificial Sequence
  neuraminidase__InfluenzaA__AHC58662
MNPNQKIITIGSVSLTISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24019 - protein, 469 aa, Artificial Sequence
  neuraminidase__InfluenzaA__AHC58686
MNPNQKIITIGSVSLTISTICFFMQIAILITTVTLHFKQYEFNSPPNNQVVLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24020 - protein, 469 aa, Artificial Sequence
  neuraminidase__InfluenzaA__AHC58698
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCAVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24021 - protein, 469 aa, Artificial Sequence; identical to SEQ ID NO: 22922
  neuraminidase__InfluenzaA__AHC58710

SEQ ID NO: 24022 - protein, 469 aa, Artificial Sequence; identical to SEQ ID NO: 22922
  neuraminidase__InfluenzaA__AHC58722

SEQ ID NO: 24023 - protein, 469 aa, Artificial Sequence
  neuraminidase__InfluenzaA__AHC58734
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGIRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24024 - protein, 469 aa, Artificial Sequence; identical to SEQ ID NO: 23971
  neuraminidase__InfluenzaA__AHC58746

SEQ ID NO: 24025 - protein, 469 aa, Artificial Sequence; identical to SEQ ID NO: 23975
  neuraminidase__InfluenzaA__AHC58758

SEQ ID NO: 24026 - protein, 469 aa, Artificial Sequence; identical to SEQ ID NO: 23971
  neuraminidase__InfluenzaA__AHC58770

SEQ ID NO: 24027 - protein, 469 aa, Artificial Sequence; identical to SEQ ID NO: 19518
  neuraminidase__InfluenzaA__AHC58782

SEQ ID NO: 24028 - protein, 469 aa, Artificial Sequence; identical to SEQ ID NO: 23971
  neuraminidase__InfluenzaA__AHC58806

SEQ ID NO: 24029 - protein, 469 aa, Artificial Sequence
  neuraminidase__InfluenzaA__AHC58818
MNPNQKIITIGSVSLTISTICFFIQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24030 - protein, 469 aa, Artificial Sequence; identical to SEQ ID NO: 24020
  neuraminidase__InfluenzaA__AHC58830

SEQ ID NO: 24031 - protein, 469 aa, Artificial Sequence; identical to SEQ ID NO: 23971
  neuraminidase__InfluenzaA__AHC58842

SEQ ID NO: 24032 - protein, 469 aa, Artificial Sequence
  neuraminidase__InfluenzaA__AHC58866
MNPNQKIITIGSVSLTISTICFFMQIAILITTVTLHFKQCEFNSPPNNRVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETGVLWTSNSIVVFCGTSGTYGTGSWPDGADLNLMPI

SEQ ID NO: 24033 - protein, 469 aa, Artificial Sequence; identical to SEQ ID NO: 24020
  neuraminidase__InfluenzaA__AHC58878

SEQ ID NO: 24034 - protein, 469 aa, Artificial Sequence; identical to SEQ ID NO: 23971
  neuraminidase__InfluenzaA__AHC58890

SEQ ID NO: 24035 - protein, 469 aa, Artificial Sequence; identical to SEQ ID NO: 23975
  neuraminidase__InfluenzaA__AHC58902

SEQ ID NO: 24036 - protein, 469 aa, Artificial Sequence; identical to SEQ ID NO: 23971
  neuraminidase__InfluenzaA__AHC58996

SEQ ID NO: 24037 - protein, 469 aa, Artificial Sequence; identical to SEQ ID NO: 23971
  neuraminidase__InfluenzaA__AHC59008

SEQ ID NO: 24038 - protein, 469 aa, Artificial Sequence; identical to SEQ ID NO: 23975
  neuraminidase__InfluenzaA__AHC59020

SEQ ID NO: 24039 - protein, 469 aa, Artificial Sequence
  neuraminidase__InfluenzaA__AHC59032
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPSVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24040 - protein, 469 aa, Artificial Sequence; identical to SEQ ID NO: 24007
  neuraminidase__InfluenzaA__AHC59044

SEQ ID NO: 24041 - protein, 469 aa, Artificial Sequence; identical to SEQ ID NO: 19518
  neuraminidase__InfluenzaA__AHC59056

SEQ ID NO: 24042 - protein, 469 aa, Artificial Sequence; identical to SEQ ID NO: 23971
  neuraminidase__InfluenzaA__AHC59068

SEQ ID NO: 24043 - protein, 469 aa, Artificial Sequence; identical to SEQ ID NO: 23971
  neuraminidase__InfluenzaA__AHC59080

SEQ ID NO: 24044 - protein, 469 aa, Artificial Sequence
  neuraminidase__InfluenzaA__AHC59092
MNPNQKIITIGSVSLTISTICFFMQIAILVTTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSGHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24045 - protein, 469 aa, Artificial Sequence
  neuraminidase__InfluenzaA__AHC59104
MNPNQKIITIGSVSLTISTICFFMQIAILITTVTLHFKQYEFYSPPNNQVMLCEPTIIKRNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24046 - protein, 469 aa, Artificial Sequence
  neuraminidase__InfluenzaA__AHC59116
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGREEETEVLWTSNSIVVFCGTSGTYGTGSWPDGADLNLMPI

SEQ ID NO: 24047 - protein, 469 aa, Artificial Sequence
  neuraminidase__InfluenzaA__AHC59128
MNPNQKIITIGSVSLTISTICFFMQIAILITTVTLHFKQYEFYSPPNNQVMLCEPTIMERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCVTGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24048 - protein, 469 aa, Artificial Sequence
  neuraminidase__InfluenzaA__AHC59152
MNPNQKIITIGSVSLTISTICFFMQVAILITTVTLHFKQYEFNSPPNNQVMLCEPTIIERNITEILYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24049 - protein, 469 aa, Artificial Sequence
  neuraminidase__InfluenzaA__AHC59188
MNPNQKIITIGSVSLTISTICFFMQIAILITTVTLHFKQYEFNPPPNNQVVLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24050 - protein, 469 aa, Artificial Sequence; identical to SEQ ID NO: 19518
  neuraminidase__InfluenzaA__AHC59200

SEQ ID NO: 24051 - protein, 469 aa, Artificial Sequence
  neuraminidase__InfluenzaA__AHC59212
MNPNQKIITIGSVSLTISTICFFMQIATLITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24052 - protein, 469 aa, Artificial Sequence; identical to SEQ ID NO: 23975
  neuraminidase__InfluenzaA__AHC59224

SEQ ID NO: 24053 - protein, 469 aa, Artificial Sequence
  neuraminidase__InfluenzaA__AHC59236
MNPNQKIITIGSVSLTISTICFFMQIAILITTVTLHFKQYEFYSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVHDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24054 - protein, 469 aa, Artificial Sequence; identical to SEQ ID NO: 23975
  neuraminidase__InfluenzaA__AHC59260

SEQ ID NO: 24055 - protein, 469 aa, Artificial Sequence; identical to SEQ ID NO: 23971
  neuraminidase__InfluenzaA__AHC59272

SEQ ID NO: 24056 - protein, 469 aa, Artificial Sequence; identical to SEQ ID NO: 23975
  neuraminidase__InfluenzaA__AHC59284

SEQ ID NO: 24057 - protein, 469 aa, Artificial Sequence
  neuraminidase__InfluenzaA__AHC59296
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDIKIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24058 - protein, 469 aa, Artificial Sequence
  neuraminidase__InfluenzaA__AHC59308
MNPNQKIITIGSVSLTISTICFFMQIAILITTVTLHFKQYEFNPPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVMVDRGNRSGYSGIFSVEGKSCINRCFYVELIRGRKEETEVLWTSNSIVVFCGTSGTYGTGSWPDGADLNLMPI

SEQ ID NO: 24059 - protein, 469 aa, Artificial Sequence; identical to SEQ ID NO: 23883
  neuraminidase__InfluenzaA__AHC59320

SEQ ID NO: 24060 - protein, 469 aa, Artificial Sequence; identical to SEQ ID NO: 22146
  neuraminidase__InfluenzaA__AHC59332

SEQ ID NO: 24061 - protein, 469 aa, Artificial Sequence; identical to SEQ ID NO: 24019
  neuraminidase__InfluenzaA__AHC59344

SEQ ID NO: 24062 - protein, 469 aa, Artificial Sequence
  neuraminidase__InfluenzaA__AHC59368
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTIDETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24063 - protein, 469 aa, Artificial Sequence; identical to SEQ ID NO: 23971
  neuraminidase__InfluenzaA__AHC59380

SEQ ID NO: 24064 - protein, 469 aa, Artificial Sequence; identical to SEQ ID NO: 22922
  neuraminidase__InfluenzaA__AHC59392

SEQ ID NO: 24065 - protein, 469 aa, Artificial Sequence; identical to SEQ ID NO: 24007
  neuraminidase__InfluenzaA__AHC59404

SEQ ID NO: 24066 - protein, 469 aa, Artificial Sequence; identical to SEQ ID NO: 23975
  neuraminidase__InfluenzaA__AHC59416

SEQ ID NO: 24067 - protein, 469 aa, Artificial Sequence
  neuraminidase__InfluenzaA__AHC59428
MNPNQKIITIGSVSLTISTICFFMQIAILITTVTLHFKQYEFYSPPNNQVMLCEPTIIERNITEIVYLTNTTIEKEICPKLAEYRNWSKPQCDITGFAPFSKDNSIRLSAGGDIWVTREPYVSCDPDRCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24068 - protein, 469 aa, Artificial Sequence
  neuraminidase__InfluenzaA__AHC59440
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVQTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24069 - protein, 469 aa, Artificial Sequence; identical to SEQ ID NO: 23975
  neuraminidase__InfluenzaA__AHC59452

SEQ ID NO: 24070 - protein, 469 aa, Artificial Sequence; identical to SEQ ID NO: 19518
  neuraminidase__InfluenzaA__AHC59464

SEQ ID NO: 24071 - protein, 469 aa, Artificial Sequence; identical to SEQ ID NO: 23883
  neuraminidase__InfluenzaA__AHC59476

SEQ ID NO: 24072 - protein, 469 aa, Artificial Sequence; identical to SEQ ID NO: 23975
  neuraminidase__InfluenzaA__AHC59488

SEQ ID NO: 24073 - protein, 469 aa, Artificial Sequence; identical to SEQ ID NO: 23975
  neuraminidase__InfluenzaA__AHC59500

SEQ ID NO: 24074 - protein, 469 aa, Artificial Sequence; identical to SEQ ID NO: 24020
  neuraminidase__InfluenzaA__AHC59512

SEQ ID NO: 24075 - protein, 469 aa, Artificial Sequence; identical to SEQ ID NO: 24020
  neuraminidase__InfluenzaA__AHC59524

SEQ ID NO: 24076 - protein, 469 aa, Artificial Sequence; identical to SEQ ID NO: 24007
  neuraminidase__InfluenzaA__AHC59536

SEQ ID NO: 24077 - protein, 469 aa, Artificial Sequence; identical to SEQ ID NO: 23975
  neuraminidase__InfluenzaA__AHC59548

SEQ ID NO: 24078 - protein, 469 aa, Artificial Sequence; identical to SEQ ID NO: 23975
  neuraminidase__InfluenzaA__AHC59560

SEQ ID NO: 24079 - protein, 469 aa, Artificial Sequence; identical to SEQ ID NO: 24053
  neuraminidase__InfluenzaA__AHC59572

SEQ ID NO: 24080 - protein, 469 aa, Artificial Sequence; identical to SEQ ID NO: 24048
  neuraminidase__InfluenzaA__AHC59584

SEQ ID NO: 24081 - protein, 469 aa, Artificial Sequence; identical to SEQ ID NO: 24020
  neuraminidase__InfluenzaA__AHC59596

SEQ ID NO: 24082 - protein, 469 aa, Artificial Sequence; identical to SEQ ID NO: 22922
  neuraminidase__InfluenzaA__AHC59608

SEQ ID NO: 24083 - protein, 469 aa, Artificial Sequence; identical to SEQ ID NO: 24007
  neuraminidase__InfluenzaA__AHC59620

SEQ ID NO: 24084 - protein, 469 aa, Artificial Sequence; identical to SEQ ID NO: 23975
  neuraminidase__InfluenzaA__AHC59632

SEQ ID NO: 24085 - protein, 469 aa, Artificial Sequence; identical to SEQ ID NO: 23975
  neuraminidase__InfluenzaA__AHC59644

SEQ ID NO: 24086 - protein, 469 aa, Artificial Sequence
  neuraminidase__InfluenzaA__AHC59656
MNPNQKIITIGSVSLTISTICFFMQIAILITTVTMHFKQYEFNSPPNNQVMLCEPTIIERNITEIVYLTNTTIEKEICPKLAEYRNWSKPQCDITGFAPFSKDNSIRLSAGGDIWVTREPYVSCDPVKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24087 - protein, 469 aa, Artificial Sequence; identical to SEQ ID NO: 24020
  neuraminidase__InfluenzaA__AHC59668

SEQ ID NO: 24088 - protein, 469 aa, Artificial Sequence; identical to SEQ ID NO: 24048
  neuraminidase__InfluenzaA__AHC59680

SEQ ID NO: 24089 - protein, 469 aa, Artificial Sequence; identical to SEQ ID NO: 23975
  neuraminidase__InfluenzaA__AHC59704

SEQ ID NO: 24090 - protein, 469 aa, Artificial Sequence; identical to SEQ ID NO: 19518
  neuraminidase__InfluenzaA__AHC59716

SEQ ID NO: 24091 - protein, 469 aa, Artificial Sequence; identical to SEQ ID NO: 19518
  neuraminidase__InfluenzaA__AHC59728

SEQ ID NO: 24092 - protein, 469 aa, Artificial Sequence; identical to SEQ ID NO: 24020
  neuraminidase__InfluenzaA__AHC59752

SEQ ID NO: 24093 - protein, 469 aa, Artificial Sequence; identical to SEQ ID NO: 24007
  neuraminidase__InfluenzaA__AHC59764

SEQ ID NO: 24094 - protein, 469 aa, Artificial Sequence
  neuraminidase__InfluenzaA__AHC59776
MNPNQKIITIGSVSLTISTICFFMQIAILITTVTLHFKQYEFYSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24095 - protein, 469 aa, Artificial Sequence; identical to SEQ ID NO: 23971
  neuraminidase__InfluenzaA__AHC59788

SEQ ID NO: 24096 - protein, 469 aa, Artificial Sequence; identical to SEQ ID NO: 24048
  neuraminidase__InfluenzaA__AHC59800

SEQ ID NO: 24097 - protein, 469 aa, Artificial Sequence
  neuraminidase__InfluenzaA__AHC59812
MNPNQKIITIGSVSLTISTICFFMQIAILITTVTLHFKQYEFNSPPNNQVVLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVYTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24098 - protein, 469 aa, Artificial Sequence
  neuraminidase__InfluenzaA__AHC59824
MNPNQKIITIGSVSLTISTICFFMQIAILITTVTLHFKQYEFYSPPNNQVMLCEPTIIERNITEIVYLTNTTIEKEICPKLAEYRKWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24099 - protein, 469 aa, Artificial Sequence; identical to SEQ ID NO: 23975
  neuraminidase__InfluenzaA__AHC59836

SEQ ID NO: 24100 - protein, 469 aa, Artificial Sequence; identical to SEQ ID NO: 22922
  neuraminidase__InfluenzaA__AHC59848

SEQ ID NO: 24101 - protein, 469 aa, Artificial Sequence; identical to SEQ ID NO: 23971
  neuraminidase__InfluenzaA__AHC59860

SEQ ID NO: 24102 - protein, 469 aa, Artificial Sequence; identical to SEQ ID NO: 24018
  neuraminidase__InfluenzaA__AHC59872

SEQ ID NO: 24103 - protein, 469 aa, Artificial Sequence; identical to SEQ ID NO: 24007
  neuraminidase__InfluenzaA__AHC59884

SEQ ID NO: 24104 - protein, 469 aa, Artificial Sequence
  neuraminidase__InfluenzaA__AHC59895
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIKEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24105 - protein, 469 aa, Artificial Sequence; identical to SEQ ID NO: 23975
  neuraminidase__InfluenzaA__AHC59907

SEQ ID NO: 24106 - protein, 469 aa, Artificial Sequence
  neuraminidase__InfluenzaA__AHC59918
MNPNQKIITIGSVSLTISTICFFIQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQMNRQVIVDRGNRSGYSGIFSVEGKSCINRCFYVELIRGRKEETEVLWTSNSIVVFCGTSGTYGTGSWPDGADLNLMPI

SEQ ID NO: 24107 - protein, 469 aa, Artificial Sequence; identical to SEQ ID NO: 24106
  neuraminidase__InfluenzaA__AHC59930

SEQ ID NO: 24108 - protein, 469 aa, Artificial Sequence; identical to SEQ ID NO: 23975
  neuraminidase__InfluenzaA__AHC59942

SEQ ID NO: 24109 - protein, 469 aa, Artificial Sequence; identical to SEQ ID NO: 24020
  neuraminidase__InfluenzaA__AHC59954

SEQ ID NO: 24110 - protein, 469 aa, Artificial Sequence
  neuraminidase__InfluenzaA__AHC59966
MNPNQKIITIGSVSLTISTICFFMQIAILITTVTLHFKQYEFNSSPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDGSGYSGIFSVEGKSCINRCFYVELIRGRKEETEVLWTSNSIVVFCGTSGTYGTGSWPDGADLNLMPI

SEQ ID NO: 24111 - protein, 469 aa, Artificial Sequence; identical to SEQ ID NO: 22922
  neuraminidase__InfluenzaA__AHC59978

SEQ ID NO: 24112 - protein, 469 aa, Artificial Sequence; identical to SEQ ID NO: 20884
  neuraminidase__InfluenzaA__AHC59990

SEQ ID NO: 24113 - protein, 469 aa, Artificial Sequence; identical to SEQ ID NO: 24020
  neuraminidase__InfluenzaA__AHC60002

SEQ ID NO: 24114 - protein, 469 aa, Artificial Sequence; identical to SEQ ID NO: 23975
  neuraminidase__InfluenzaA__AHC60014

SEQ ID NO: 24115 - protein, 469 aa, Artificial Sequence; identical to SEQ ID NO: 19518
  neuraminidase__InfluenzaA__AHC60026

SEQ ID NO: 24116 - protein, 469 aa, Artificial Sequence; identical to SEQ ID NO: 23971
  neuraminidase__InfluenzaA__AHC60038

SEQ ID NO: 24117 - protein, 469 aa, Artificial Sequence; identical to SEQ ID NO: 23971
  neuraminidase__InfluenzaA__AHC60050

SEQ ID NO: 24118 - protein, 469 aa, Artificial Sequence
  neuraminidase__InfluenzaA__AHC60062
MNPNQKIITIGSVSLTISTICFFMQIAILITTVTMHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24119 - protein, 469 aa, Artificial Sequence; identical to SEQ ID NO: 22922
  neuraminidase__InfluenzaA__AHC60074

SEQ ID NO: 24120 - protein, 469 aa, Artificial Sequence; identical to SEQ ID NO: 23975
  neuraminidase__InfluenzaA__AHC60086

SEQ ID NO: 24121 - protein, 469 aa, Artificial Sequence
  neuraminidase__InfluenzaA__AHC60098
MNPNQKIITIGSVSLTISTICFFMQIAILITTVTLHFKQYEFYSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTIDETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24122 - protein, 469 aa, Artificial Sequence; identical to SEQ ID NO: 23971
  neuraminidase__InfluenzaA__AHC60110

SEQ ID NO: 24123 - protein, 469 aa, Artificial Sequence; identical to SEQ ID NO: 24048
  neuraminidase__InfluenzaA__AHC60122

SEQ ID NO: 24124 - protein, 469 aa, Artificial Sequence; identical to SEQ ID NO: 23975
  neuraminidase__InfluenzaA__AHC60134

SEQ ID NO: 24125 - protein, 469 aa, Artificial Sequence; identical to SEQ ID NO: 24029
  neuraminidase__InfluenzaA__AHC60146

SEQ ID NO: 24126 - protein, 469 aa, Artificial Sequence; identical to SEQ ID NO: 24106
  neuraminidase__InfluenzaA__AHC60158

SEQ ID NO: 24127 - protein, 469 aa, Artificial Sequence; identical to SEQ ID NO: 23971
  neuraminidase__InfluenzaA__AHC60182

SEQ ID NO: 24128 - protein, 469 aa, Artificial Sequence
  neuraminidase__InfluenzaA__AHC60206
MNPNQKIITIGSVSLTISIICFFMQVAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24129 - protein, 469 aa, Artificial Sequence; identical to SEQ ID NO: 22922
  neuraminidase__InfluenzaA__AHC60218

SEQ ID NO: 24130 - protein, 469 aa, Artificial Sequence; identical to SEQ ID NO: 19518
  neuraminidase__InfluenzaA__AHC60230

SEQ ID NO: 24131 - protein, 469 aa, Artificial Sequence; identical to SEQ ID NO: 23971
  neuraminidase__InfluenzaA__AHC60242

SEQ ID NO: 24132 - protein, 469 aa, Artificial Sequence; identical to SEQ ID NO: 23971
  neuraminidase__InfluenzaA__AHC60254

SEQ ID NO: 24133 - protein, 469 aa, Artificial Sequence; identical to SEQ ID NO: 23971
  neuraminidase__InfluenzaA__AHC60266

SEQ ID NO: 24134 - protein, 469 aa, Artificial Sequence; identical to SEQ ID NO: 24020
  neuraminidase__InfluenzaA__AHC60278

SEQ ID NO: 24135 - protein, 469 aa, Artificial Sequence; identical to SEQ ID NO: 23971
  neuraminidase__InfluenzaA__AHC60290

SEQ ID NO: 24136 - protein, 469 aa, Artificial Sequence
  neuraminidase__InfluenzaA__AHC60302
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIIHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24137 - protein, 469 aa, Artificial Sequence; identical to SEQ ID NO: 23971
  neuraminidase__InfluenzaA__AHC60314

SEQ ID NO: 24138 - protein, 469 aa, Artificial Sequence; identical to SEQ ID NO: 23971
  neuraminidase__InfluenzaA__AHC60326

SEQ ID NO: 24139 - protein, 469 aa, Artificial Sequence
  neuraminidase__InfluenzaA__AHC60338
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGDDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24140 - protein, 469 aa, Artificial Sequence; identical to SEQ ID NO: 20884
  neuraminidase__InfluenzaA__AHC60350

SEQ ID NO: 24141 - protein, 469 aa, Artificial Sequence
  neuraminidase__InfluenzaA__AHC60362
MNPNQKIITIGSVSLTISTICFFMQVAILITTVTLHFKQYEFNSPPNNQVMLCKPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24142 - protein, 469 aa, Artificial Sequence; identical to SEQ ID NO: 23883
  neuraminidase__InfluenzaA__AHC60374

SEQ ID NO: 24143 - protein, 469 aa, Artificial Sequence; identical to SEQ ID NO: 19518
  neuraminidase__InfluenzaA__AHC60386

SEQ ID NO: 24144 - protein, 469 aa, Artificial Sequence; identical to SEQ ID NO: 23975
  neuraminidase__InfluenzaA__AHC60398

SEQ ID NO: 24145 - protein, 469 aa, Artificial Sequence; identical to SEQ ID NO: 24007
  neuraminidase__InfluenzaA__AHC60410

SEQ ID NO: 24146 - protein, 469 aa, Artificial Sequence; identical to SEQ ID NO: 19518
  neuraminidase__InfluenzaA__AHC60422

SEQ ID NO: 24147 - protein, 469 aa, Artificial Sequence; identical to SEQ ID NO: 24007
  neuraminidase__InfluenzaA__AHC60434

SEQ ID NO: 24148 - protein, 469 aa, Artificial Sequence; identical to SEQ ID NO: 23975
  neuraminidase__InfluenzaA__AHC60446

SEQ ID NO: 24149 - protein, 469 aa, Artificial Sequence
  neuraminidase__InfluenzaA__AHC60458
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCAVVMTDGSASGKADTKILFIEEGKIVHTSTLSGSAQHVEECSCYPRYPGVRCVCRDNWKGSNRPIVDINIKDHSIVSSYVCSGLVGDTPRKNDGSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24150 - protein, 469 aa, Artificial Sequence; identical to SEQ ID NO: 24020
  neuraminidase__InfluenzaA__AHC60470

SEQ ID NO: 24151 - protein, 469 aa, Artificial Sequence
  neuraminidase__InfluenzaA__AHC60482
MNPNQKIITIGSVSLTISTICFFMQIAILTTTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24152 - protein, 469 aa, Artificial Sequence; identical to SEQ ID NO: 23971
  neuraminidase__InfluenzaA__AHC60494

SEQ ID NO: 24153 - protein, 469 aa, Artificial Sequence; identical to SEQ ID NO: 23971
  neuraminidase__InfluenzaA__AHC60506

SEQ ID NO: 24154 - protein, 469 aa, Artificial Sequence; identical to SEQ ID NO: 23975
  neuraminidase__InfluenzaA__AHC60518

SEQ ID NO: 24155 - protein, 469 aa, Artificial Sequence; identical to SEQ ID NO: 23975
  neuraminidase__InfluenzaA__AHC60542

SEQ ID NO: 24156 - protein, 469 aa, Artificial Sequence
  neuraminidase__InfluenzaA__AHC60554
MNPNQKIITIGSVSLTISTICFFMQIAILITTVTLHFKQYEFYSPPNNQVMLCEPTMIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGTWPDGADLNLMPI

SEQ ID NO: 24157 - protein, 469 aa, Artificial Sequence
  neuraminidase__InfluenzaA__AHC60566
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQVNRQVIVDRGDRSGYSGIFSVEGKSCINRCFYVELIRGRKEETEVLWTSNSIVVFCGTSGTYGTGSWPDGADLNLMPI

SEQ ID NO: 24158 - protein, 469 aa, Artificial Sequence; identical to SEQ ID NO: 22922
  neuraminidase__InfluenzaA__AHC60578

SEQ ID NO: 24159 - protein, 469 aa, Artificial Sequence; identical to SEQ ID NO: 23971
  neuraminidase__InfluenzaA__AHC60590

SEQ ID NO: 24160 - protein, 469 aa, Artificial Sequence
  neuraminidase__InfluenzaA__AHC60602
MNPNQKIITIGSVSLTISTICFFMQIAILITTVTLHFKQYEFNPPPNNQVVLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24161 - protein, 469 aa, Artificial Sequence; identical to SEQ ID NO: 19518
  neuraminidase__InfluenzaA__AHC60614

SEQ ID NO: 24162 - protein, 469 aa, Artificial Sequence; identical to SEQ ID NO: 22922
  neuraminidase__InfluenzaA__AHC60626

SEQ ID NO: 24163 - protein, 469 aa, Artificial Sequence
  neuraminidase__InfluenzaA__AHC60650
MNPNQKIITIGSVSLTISTICFFMQIAILITTVTLHFKQYEFYSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDENATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24164 - protein, 469 aa, Artificial Sequence; identical to SEQ ID NO: 24020
  neuraminidase__InfluenzaA__AHC60662

SEQ ID NO: 24165 - protein, 469 aa, Artificial Sequence; identical to SEQ ID NO: 23975
  neuraminidase__InfluenzaA__AHC60674

SEQ ID NO: 24166 - protein, 469 aa, Artificial Sequence; identical to SEQ ID NO: 19518
  neuraminidase__InfluenzaA__AHC60686

SEQ ID NO: 24167 - protein, 469 aa, Artificial Sequence; identical to SEQ ID NO: 23975
  neuraminidase__InfluenzaA__AHC60698

SEQ ID NO: 24168 - protein, 469 aa, Artificial Sequence; identical to SEQ ID NO: 23971
  neuraminidase__InfluenzaA__AHC60710

SEQ ID NO: 24169 - protein, 469 aa, Artificial Sequence; identical to SEQ ID NO: 24020
  neuraminidase__InfluenzaA__AHC60722

SEQ ID NO: 24170 - protein, 469 aa, Artificial Sequence
  neuraminidase__InfluenzaA__AHC60734
MNPNQKIITIGSVSLTISTICFFMQIAILITTVTLHFKQYEFNSPPNNQVMLCEPTIIERNITEIVYLINTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24171 - protein, 469 aa, Artificial Sequence; identical to SEQ ID NO: 24007
  neuraminidase__InfluenzaA__AHC60746

SEQ ID NO: 24172 - protein, 469 aa, Artificial Sequence; identical to SEQ ID NO: 24106
  neuraminidase__InfluenzaA__AHC60770

SEQ ID NO: 24173 - protein, 469 aa, Artificial Sequence
  neuraminidase__InfluenzaA__AHC60782
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSGYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24174 - protein, 469 aa, Artificial Sequence; identical to SEQ ID NO: 24018
  neuraminidase__InfluenzaA__AHC60794

SEQ ID NO: 24175 - protein, 469 aa, Artificial Sequence
  neuraminidase__InfluenzaA__AHC60806
MNPNQKIITIGSVSLTISTICFFMQIAILITTVTLHFKQCEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETGVLWTSNSIVVFCGTSGTYGTGSWPDGADLNLMPI

SEQ ID NO: 24176 - protein, 469 aa, Artificial Sequence; identical to SEQ ID NO: 20884
  neuraminidase__InfluenzaA__AHC60818

SEQ ID NO: 24177 - protein, 469 aa, Artificial Sequence; identical to SEQ ID NO: 23975
  neuraminidase__InfluenzaA__AHC60830

SEQ ID NO: 24178 - protein, 469 aa, Artificial Sequence; identical to SEQ ID NO: 24156
  neuraminidase__InfluenzaA__AHC60842

SEQ ID NO: 24179 - protein, 469 aa, Artificial Sequence; identical to SEQ ID NO: 23975
  neuraminidase__InfluenzaA__AHC60854

SEQ ID NO: 24180 - protein, 469 aa, Artificial Sequence; identical to SEQ ID NO: 24020
  neuraminidase__InfluenzaA__AHC60866

SEQ ID NO: 24181 - protein, 469 aa, Artificial Sequence; identical to SEQ ID NO: 24007
  neuraminidase__InfluenzaA__AHC60878

SEQ ID NO: 24182 - protein, 469 aa, Artificial Sequence; identical to SEQ ID NO: 24007
  neuraminidase__InfluenzaA__AHC60890

SEQ ID NO: 24183 - protein, 469 aa, Artificial Sequence; identical to SEQ ID NO: 24106
  neuraminidase__InfluenzaA__AHC60902

SEQ ID NO: 24184 - protein, 469 aa, Artificial Sequence; identical to SEQ ID NO: 23971
  neuraminidase__InfluenzaA__AHC60914

SEQ ID NO: 24185 - protein, 469 aa, Artificial Sequence; identical to SEQ ID NO: 23975
  neuraminidase__InfluenzaA__AHC60926

SEQ ID NO: 24186 - protein, 469 aa, Artificial Sequence; identical to SEQ ID NO: 23971
  neuraminidase__InfluenzaA__AHC60938

SEQ ID NO: 24187 - protein, 469 aa, Artificial Sequence; identical to SEQ ID NO: 23975
  neuraminidase__InfluenzaA__AHC60950

SEQ ID NO: 24188 - protein, 469 aa, Artificial Sequence
  neuraminidase__InfluenzaA__AHC60962
MNPNQKIITIGSVSLTISTICFFMQIAILITTVTLHFKQYEFYSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCVTGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24189 - protein, 469 aa, Artificial Sequence; identical to SEQ ID NO: 24020
  neuraminidase__InfluenzaA__AHC60974

SEQ ID NO: 24190 - protein, 469 aa, Artificial Sequence; identical to SEQ ID NO: 23971
  neuraminidase__InfluenzaA__AHC60986

SEQ ID NO: 24191 - protein, 469 aa, Artificial Sequence; identical to SEQ ID NO: 24118
  neuraminidase__InfluenzaA__AHC60998

SEQ ID NO: 24192 - protein, 469 aa, Artificial Sequence; identical to SEQ ID NO: 24018
  neuraminidase__InfluenzaA__AHC61010

SEQ ID NO: 24193 - protein, 469 aa, Artificial Sequence
  neuraminidase__InfluenzaA__AHC61022
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSISHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24194 - protein, 469 aa, Artificial Sequence; identical to SEQ ID NO: 19518
  neuraminidase__InfluenzaA__AHC61034

SEQ ID NO: 24195 - protein, 469 aa, Artificial Sequence; identical to SEQ ID NO: 23971
  neuraminidase__InfluenzaA__AHC61046

SEQ ID NO: 24196 - protein, 469 aa, Artificial Sequence; identical to SEQ ID NO: 24020
  neuraminidase__InfluenzaA__AHC61058

SEQ ID NO: 24197 - protein, 469 aa, Artificial Sequence; identical to SEQ ID NO: 23883
  neuraminidase__InfluenzaA__AHC61070

SEQ ID NO: 24198 - protein, 469 aa, Artificial Sequence
  neuraminidase__InfluenzaA__AHC61082
MNPNQKIITIGSVSLTISTICFFMQIAILITTVTLHFKQYEFNSPPNNQVVLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETGVLWTSNSIVVFCGTSGTYGTGSWPDGADLNLMPI

SEQ ID NO: 24199 - protein, 469 aa, Artificial Sequence; identical to SEQ ID NO: 19518
  neuraminidase__InfluenzaA__AHC61094

SEQ ID NO: 24200 - protein, 469 aa, Artificial Sequence; identical to SEQ ID NO: 24007
  neuraminidase__InfluenzaA__AHC61106

SEQ ID NO: 24201 - protein, 469 aa, Artificial Sequence; identical to SEQ ID NO: 24007
  neuraminidase__InfluenzaA__AHC61118

SEQ ID NO: 24202 - protein, 469 aa, Artificial Sequence; identical to SEQ ID NO: 23971
  neuraminidase__InfluenzaA__AHC61130

SEQ ID NO: 24203 - protein, 469 aa, Artificial Sequence; identical to SEQ ID NO: 24118
  neuraminidase__InfluenzaA__AHC61142

SEQ ID NO: 24204 - protein, 469 aa, Artificial Sequence; identical to SEQ ID NO: 24007
  neuraminidase__InfluenzaA__AHC61154

SEQ ID NO: 24205 - protein, 469 aa, Artificial Sequence
  neuraminidase__InfluenzaA__AHC61166
MNPNQKIITIGSVSLTISTICFFMQVAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQTNRQVIVDRGNRSGYSGIFSVEGKSCINRCFYVELIRGRKEETEVLWTSNSIVVFCGTSGTYGTGSWPDGADLNLMPI

SEQ ID NO: 24206 - protein, 469 aa, Artificial Sequence; identical to SEQ ID NO: 23971
  neuraminidase__InfluenzaA__AHC61178

SEQ ID NO: 24207 - protein, 469 aa, Artificial Sequence; identical to SEQ ID NO: 24007
  neuraminidase__InfluenzaA__AHC61190

SEQ ID NO: 24208 - protein, 469 aa, Artificial Sequence; identical to SEQ ID NO: 24020
  neuraminidase__InfluenzaA__AHC61202

SEQ ID NO: 24209 - protein, 469 aa, Artificial Sequence; identical to SEQ ID NO: 23975
  neuraminidase__InfluenzaA__AHC61214

SEQ ID NO: 24210 - protein, 469 aa, Artificial Sequence; identical to SEQ ID NO: 24020
  neuraminidase__InfluenzaA__AHC61226

SEQ ID NO: 24211 - protein, 469 aa, Artificial Sequence; identical to SEQ ID NO: 24007
  neuraminidase__InfluenzaA__AHC61238

SEQ ID NO: 24212 - protein, 469 aa, Artificial Sequence; identical to SEQ ID NO: 24188
  neuraminidase__InfluenzaA__AHC61250

SEQ ID NO: 24213 - protein, 469 aa, Artificial Sequence; identical to SEQ ID NO: 23971
  neuraminidase__InfluenzaA__AHC61262

SEQ ID NO: 24214 - protein, 469 aa, Artificial Sequence; identical to SEQ ID NO: 23975
  neuraminidase__InfluenzaA__AHC61274

SEQ ID NO: 24215 - protein, 469 aa, Artificial Sequence; identical to SEQ ID NO: 19518
  neuraminidase__InfluenzaA__AHC61286

SEQ ID NO: 24216 - protein, 469 aa, Artificial Sequence; identical to SEQ ID NO: 24019
  neuraminidase__InfluenzaA__AHC61298

SEQ ID NO: 24217 - protein, 469 aa, Artificial Sequence
  neuraminidase__InfluenzaA__AHC61310
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIIDRGNRSGYSGIFSVEGKSCINRCFYVELIRGRKEETEVLWTSSSIVVFCGTSGTYGTGSWPDGADLNLMPI

SEQ ID NO: 24218 - protein, 469 aa, Artificial Sequence; identical to SEQ ID NO: 24048
  neuraminidase__InfluenzaA__AHC61322

SEQ ID NO: 24219 - protein, 469 aa, Artificial Sequence; identical to SEQ ID NO: 24007
  neuraminidase__InfluenzaA__AHC61334

SEQ ID NO: 24220 - protein, 469 aa, Artificial Sequence; identical to SEQ ID NO: 23975
  neuraminidase__InfluenzaA__AHC61346

SEQ ID NO: 24221 - protein, 469 aa, Artificial Sequence
  neuraminidase__InfluenzaA__AHC61358
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDISSSSHCLDPNNEEGGHGVKGWAFDDGNDVWMGRTINETSRLGYETFKVIKGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24222 - protein, 469 aa, Artificial Sequence; identical to SEQ ID NO: 24020
  neuraminidase__InfluenzaA__AHC61370

SEQ ID NO: 24223 - protein, 469 aa, Artificial Sequence; identical to SEQ ID NO: 24048
  neuraminidase__InfluenzaA__AHC61382

SEQ ID NO: 24224 - protein, 469 aa, Artificial Sequence; identical to SEQ ID NO: 24020
  neuraminidase__InfluenzaA__AHC61394

SEQ ID NO: 24225 - protein, 469 aa, Artificial Sequence; identical to SEQ ID NO: 24048
  neuraminidase__InfluenzaA__AHC61406

SEQ ID NO: 24226 - protein, 469 aa, Artificial Sequence; identical to SEQ ID NO: 24007
  neuraminidase__InfluenzaA__AHC61418

SEQ ID NO: 24227 - protein, 469 aa, Artificial Sequence; identical to SEQ ID NO: 19518
  neuraminidase__InfluenzaA__AHC61430

SEQ ID NO: 24228 - protein, 469 aa, Artificial Sequence; identical to SEQ ID NO: 24020
  neuraminidase__InfluenzaA__AHC61442

SEQ ID NO: 24229 - protein, 469 aa, Artificial Sequence; identical to SEQ ID NO: 24020
  neuraminidase__InfluenzaA__AHC61454

SEQ ID NO: 24230 - protein, 469 aa, Artificial Sequence
  neuraminidase__InfluenzaA__AHC61466
MNPNQKIITIGSVSLTISTICFFMQIAILITTVTLHFKQYEFNSPPNNQVMLCEPTIIERNTTEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDKGNRSGYSGIFSVEGKSCINRCFYVELIRGRKEETEVLWTSNSIVVFCGTSGTYGTGSWPDGADLNLMPI

SEQ ID NO: 24231 - protein, 469 aa, Artificial Sequence; identical to SEQ ID NO: 23971
  neuraminidase__InfluenzaA__AHC61478

SEQ ID NO: 24232 - protein, 469 aa, Artificial Sequence; identical to SEQ ID NO: 24007
  neuraminidase__InfluenzaA__AHC61490

SEQ ID NO: 24233 - protein, 469 aa, Artificial Sequence; identical to SEQ ID NO: 23971
  neuraminidase__InfluenzaA__AHC61502

SEQ ID NO: 24234 - protein, 469 aa, Artificial Sequence; identical to SEQ ID NO: 24020
  neuraminidase__InfluenzaA__AHC61514

SEQ ID NO: 24235 - protein, 469 aa, Artificial Sequence; identical to SEQ ID NO: 22922
  neuraminidase__InfluenzaA__AHC61526

SEQ ID NO: 24236 - protein, 469 aa, Artificial Sequence
  neuraminidase__InfluenzaA__AHC61538
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGSHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24237 - protein, 469 aa, Artificial Sequence; identical to SEQ ID NO: 24020
  neuraminidase__InfluenzaA__AHC61550

SEQ ID NO: 24238 - protein, 469 aa, Artificial Sequence
  neuraminidase__InfluenzaA__AHC61562
MNPNQKIITIGSVSLTISTICFFMQIAILITTVTLHFKQYEFYSPPNNQVMLCEPTMIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVESKSCINRCFYVELIRGRKEETEVLWTSNSIVVFCGTSGTYGTGTWPDGADLNLMPI

SEQ ID NO: 24239 - protein, 469 aa, Artificial Sequence; identical to SEQ ID NO: 24019
  neuraminidase__InfluenzaA__AHC61574

SEQ ID NO: 24240 - protein, 469 aa, Artificial Sequence; identical to SEQ ID NO: 24020
  neuraminidase__InfluenzaA__AHC61586

SEQ ID NO: 24241 - protein, 469 aa, Artificial Sequence; identical to SEQ ID NO: 22922
  neuraminidase__InfluenzaA__AHC61598

SEQ ID NO: 24242 - protein, 469 aa, Artificial Sequence; identical to SEQ ID NO: 23971
  neuraminidase__InfluenzaA__AHC61610

SEQ ID NO: 24243 - protein, 469 aa, Artificial Sequence; identical to SEQ ID NO: 24019
  neuraminidase__InfluenzaA__AHC61622

SEQ ID NO: 24244 - protein, 469 aa, Artificial Sequence; identical to SEQ ID NO: 19518
  neuraminidase__InfluenzaA__AHC61634

SEQ ID NO: 24245 - protein, 469 aa, Artificial Sequence; identical to SEQ ID NO: 19518
  neuraminidase__InfluenzaA__AHC61646

SEQ ID NO: 24246 - protein, 469 aa, Artificial Sequence; identical to SEQ ID NO: 19518
  neuraminidase__InfluenzaA__AHC61658

SEQ ID NO: 24247 - protein, 469 aa, Artificial Sequence; identical to SEQ ID NO: 22922
  neuraminidase__InfluenzaA__AHC61670

SEQ ID NO: 24248 - protein, 469 aa, Artificial Sequence; identical to SEQ ID NO: 23975
  neuraminidase__InfluenzaA__AHC61682

SEQ ID NO: 24249 - protein, 469 aa, Artificial Sequence; identical to SEQ ID NO: 22922
  neuraminidase__InfluenzaA__AHC61694

SEQ ID NO: 24250 - protein, 469 aa, Artificial Sequence
  neuraminidase__InfluenzaA__AHC61706
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKEHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24251 - protein, 469 aa, Artificial Sequence
  neuraminidase__InfluenzaA__AHC61718
MNPNQKIITIGSVSLTISTICFFMQIAILITTVTLHFKQCEFNSPPNNQVMLCEPTIIERNITEIVYLTNTTIEKEICPKLTEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETGVLWTSNSIVVFCGTSGTYGTGSWPDGADLNLMPI

SEQ ID NO: 24252 - protein, 469 aa, Artificial Sequence; identical to SEQ ID NO: 23971
  neuraminidase__InfluenzaA__AHC61730

SEQ ID NO: 24253 - protein, 469 aa, Artificial Sequence; identical to SEQ ID NO: 24020
  neuraminidase__InfluenzaA__AHC61742

SEQ ID NO: 24254 - protein, 469 aa, Artificial Sequence; identical to SEQ ID NO: 23971
  neuraminidase__InfluenzaA__AHC61754

SEQ ID NO: 24255 - protein, 469 aa, Artificial Sequence; identical to SEQ ID NO: 19518
  neuraminidase__InfluenzaA__AHC61766

SEQ ID NO: 24256 - protein, 469 aa, Artificial Sequence; identical to SEQ ID NO: 24007
  neuraminidase__InfluenzaA__AHC61778

SEQ ID NO: 24257 - protein, 469 aa, Artificial Sequence; identical to SEQ ID NO: 24045
  neuraminidase__InfluenzaA__AHC61790

SEQ ID NO: 24258 - protein, 469 aa, Artificial Sequence; identical to SEQ ID NO: 23975
  neuraminidase__InfluenzaA__AHC61802

SEQ ID NO: 24259 - protein, 469 aa, Artificial Sequence; identical to SEQ ID NO: 23971
  neuraminidase__InfluenzaA__AHC61814

SEQ ID NO: 24260 - protein, 469 aa, Artificial Sequence
  neuraminidase__InfluenzaA__AHC61826
MNPNQKIITIGSVSLTISTICFFMQIAILITTVTLHFKQYEFNSPPNNQVVLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRSDRSGYSGIFSVEGKSCINRCFYVELIRGRKEETEVLWTSNSIVVFCGTSGTYGTGSWPDGADLNLMPI

SEQ ID NO: 24261 - protein, 469 aa, Artificial Sequence; identical to SEQ ID NO: 23971
  neuraminidase__InfluenzaA__AHC61838

SEQ ID NO: 24262 - protein, 469 aa, Artificial Sequence; identical to SEQ ID NO: 24007
  neuraminidase__InfluenzaA__AHC61850

SEQ ID NO: 24263 - protein, 469 aa, Artificial Sequence; identical to SEQ ID NO: 24020
  neuraminidase__InfluenzaA__AHC61862

SEQ ID NO: 24264 - protein, 469 aa, Artificial Sequence; identical to SEQ ID NO: 23971
  neuraminidase__InfluenzaA__AHC61874

SEQ ID NO: 24265 - protein, 469 aa, Artificial Sequence
  neuraminidase__InfluenzaA__AHC61886
MNPNQKIITIGSVSLTISTICFFMQIAILITTVTLHFKQYEFNPPPNNQVVLCEPTIIERNITEIVYLTNTTIEKEICPKPAEYRHWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24266 - protein, 469 aa, Artificial Sequence; identical to SEQ ID NO: 23975
  neuraminidase__InfluenzaA__AHC61898

SEQ ID NO: 24267 - protein, 469 aa, Artificial Sequence; identical to SEQ ID NO: 24007
  neuraminidase__InfluenzaA__AHC61910

SEQ ID NO: 24268 - protein, 469 aa, Artificial Sequence; identical to SEQ ID NO: 19518
  neuraminidase__InfluenzaA__AHC61934

SEQ ID NO: 24269 - protein, 469 aa, Artificial Sequence
  neuraminidase__InfluenzaA__AHC61946
MNPNQKIITIGSVSLTISTICFFMQIAILITTVTLHFKQYESYSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRNPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24270 - protein, 469 aa, Artificial Sequence; identical to SEQ ID NO: 22922
  neuraminidase__InfluenzaA__AHC61958

SEQ ID NO: 24271 - protein, 469 aa, Artificial Sequence; identical to SEQ ID NO: 23971
  neuraminidase__InfluenzaA__AHC61970

SEQ ID NO: 24272 - protein, 469 aa, Artificial Sequence
  neuraminidase__InfluenzaA__AHC61982
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCAVVMTDGSASGKADTKILFIEEGKIVHTSTLSGSAQHVEECSCYPRYPGVRCVCRDNWKGSNRPIVDINIKDHGIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24273 - protein, 469 aa, Artificial Sequence; identical to SEQ ID NO: 23975
  neuraminidase__InfluenzaA__AHC61994

SEQ ID NO: 24274 - protein, 469 aa, Artificial Sequence; identical to SEQ ID NO: 24007
  neuraminidase__InfluenzaA__AHC62006

SEQ ID NO: 24275 - protein, 469 aa, Artificial Sequence; identical to SEQ ID NO: 23971
  neuraminidase__InfluenzaA__AHC62018

SEQ ID NO: 24276 - protein, 469 aa, Artificial Sequence; identical to SEQ ID NO: 22922
  neuraminidase__InfluenzaA__AHC62030

SEQ ID NO: 24277 - protein, 469 aa, Artificial Sequence; identical to SEQ ID NO: 23975
  neuraminidase__InfluenzaA__AHC62042

SEQ ID NO: 24278 - protein, 469 aa, Artificial Sequence; identical to SEQ ID NO: 24048
  neuraminidase__InfluenzaA__AHC62053

SEQ ID NO: 24279 - protein, 469 aa, Artificial Sequence
  neuraminidase__InfluenzaA__AHC62065
MNPNQKIITIGSVSLTISTICFFMQIAILVTTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24280 - protein, 469 aa, Artificial Sequence; identical to SEQ ID NO: 24106
  neuraminidase__InfluenzaA__AHC62077

SEQ ID NO: 24281 - protein, 469 aa, Artificial Sequence; identical to SEQ ID NO: 24020
  neuraminidase__InfluenzaA__AHC62089

SEQ ID NO: 24282 - protein, 469 aa, Artificial Sequence; identical to SEQ ID NO: 23971
  neuraminidase__InfluenzaA__AHC62101

SEQ ID NO: 24283 - protein, 469 aa, Artificial Sequence; identical to SEQ ID NO: 24020
  neuraminidase__InfluenzaA__AHC62113

SEQ ID NO: 24284 - protein, 469 aa, Artificial Sequence
  neuraminidase__InfluenzaA__AHC62125
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNKSGYSGIFSVEGKSCINRCFYVELIRGRKEETEVLWTSNSIVVFCGTSGTYGTGSWPDGADLNLMPI

SEQ ID NO: 24285 - protein, 469 aa, Artificial Sequence
  neuraminidase__InfluenzaA__AHC62137
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24286 - protein, 469 aa, Artificial Sequence
  neuraminidase__InfluenzaA__AHC62149
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIRDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24287 - protein, 469 aa, Artificial Sequence; identical to SEQ ID NO: 24007
  neuraminidase__InfluenzaA__AHC62161

SEQ ID NO: 24288 - protein, 469 aa, Artificial Sequence
  neuraminidase__InfluenzaA__AHC62173
MNPNQKIITIGSVSLTISTICFFMQIAILITTVTLHFKQCEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24289 - protein, 469 aa, Artificial Sequence; identical to SEQ ID NO: 24020
  neuraminidase__InfluenzaA__AHC62185

SEQ ID NO: 24290 - protein, 469 aa, Artificial Sequence; identical to SEQ ID NO: 22922
  neuraminidase__InfluenzaA__AHC62197

SEQ ID NO: 24291 - protein, 469 aa, Artificial Sequence
  neuraminidase__InfluenzaA__AHC62209
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKNHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24292 - protein, 469 aa, Artificial Sequence; identical to SEQ ID NO: 23975
  neuraminidase__InfluenzaA__AHC62221

SEQ ID NO: 24293 - protein, 469 aa, Artificial Sequence; identical to SEQ ID NO: 19518
  neuraminidase__InfluenzaA__AHC62233

SEQ ID NO: 24294 - protein, 469 aa, Artificial Sequence; identical to SEQ ID NO: 23971
  neuraminidase__InfluenzaA__AHC62245

SEQ ID NO: 24295 - protein, 469 aa, Artificial Sequence
  neuraminidase__InfluenzaA__AHC62257
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVGRGDRSGYSGIFSVEGKSCINRCFYVELIRGRKEETEVLWTSNSIVVFCGTSGTYGTGSWPDGADLNLMPI

SEQ ID NO: 24296 - protein, 469 aa, Artificial Sequence; identical to SEQ ID NO: 24048
  neuraminidase__InfluenzaA__AHC62269

SEQ ID NO: 24297 - protein, 469 aa, Artificial Sequence; identical to SEQ ID NO: 24020
  neuraminidase__InfluenzaA__AHC62281

SEQ ID NO: 24298 - protein, 469 aa, Artificial Sequence; identical to SEQ ID NO: 23975
  neuraminidase__InfluenzaA__AHC62293

SEQ ID NO: 24299 - protein, 469 aa, Artificial Sequence; identical to SEQ ID NO: 19518
  neuraminidase__InfluenzaA__AHC62305

SEQ ID NO: 24300 - protein, 469 aa, Artificial Sequence; identical to SEQ ID NO: 23971
  neuraminidase__InfluenzaA__AHC62317

SEQ ID NO: 24301 - protein, 469 aa, Artificial Sequence
  neuraminidase__InfluenzaA__AHC62329
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIADRGDRSGYSGIFSVEGKSCINRCFYVELIRGRKEETEVLWTSNSIVVFCGTSGTYGTGSWPDGADLNLMPI

SEQ ID NO: 24302 - protein, 469 aa, Artificial Sequence; identical to SEQ ID NO: 23971
  neuraminidase__InfluenzaA__AHC62341

SEQ ID NO: 24303 - protein, 469 aa, Artificial Sequence
  neuraminidase__InfluenzaA__AHC62353
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKTDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24304 - protein, 469 aa, Artificial Sequence; identical to SEQ ID NO: 23971
  neuraminidase__InfluenzaA__AHC62365

SEQ ID NO: 24305 - protein, 469 aa, Artificial Sequence; identical to SEQ ID NO: 24188
  neuraminidase__InfluenzaA__AHC62377

SEQ ID NO: 24306 - protein, 469 aa, Artificial Sequence; identical to SEQ ID NO: 24020
  neuraminidase__InfluenzaA__AHC62389

SEQ ID NO: 24307 - protein, 469 aa, Artificial Sequence; identical to SEQ ID NO: 24020
  neuraminidase__InfluenzaA__AHC62401

SEQ ID NO: 24308 - protein, 469 aa, Artificial Sequence; identical to SEQ ID NO: 24048
  neuraminidase__InfluenzaA__AHC62413

SEQ ID NO: 24309 - protein, 469 aa, Artificial Sequence; identical to SEQ ID NO: 24106
  neuraminidase__InfluenzaA__AHC62425

SEQ ID NO: 24310 - protein, 469 aa, Artificial Sequence; identical to SEQ ID NO: 19518
  neuraminidase__InfluenzaA__AHC62437

SEQ ID NO: 24311 - protein, 469 aa, Artificial Sequence; identical to SEQ ID NO: 24020
  neuraminidase__InfluenzaA__AHC62449

SEQ ID NO: 24312 - protein, 469 aa, Artificial Sequence; identical to SEQ ID NO: 23975
  neuraminidase__InfluenzaA__AHC62461

SEQ ID NO: 24313 - protein, 469 aa, Artificial Sequence; identical to SEQ ID NO: 23971
  neuraminidase__InfluenzaA__AHC62473

SEQ ID NO: 24314 - protein, 469 aa, Artificial Sequence; identical to SEQ ID NO: 22146
  neuraminidase__InfluenzaA__AHC62485

SEQ ID NO: 24315 - protein, 469 aa, Artificial Sequence; identical to SEQ ID NO: 24020
  neuraminidase__InfluenzaA__AHC62509

SEQ ID NO: 24316 - protein, 469 aa, Artificial Sequence
  neuraminidase__InfluenzaA__AHC62521
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIIVFCGTSGTYGTGSWPDGADLNLMPI

SEQ ID NO: 24317 - protein, 469 aa, Artificial Sequence
  neuraminidase__InfluenzaA__AHC62533
MNPNQKIITIGSVSLTISTICFFMQVAILITTVTLHFKQYEFNSPPNNQVMLCEPTIIERNITEILYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGNGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24318 - protein, 469 aa, Artificial Sequence; identical to SEQ ID NO: 24175
  neuraminidase__InfluenzaA__AHC62545

SEQ ID NO: 24319 - protein, 469 aa, Artificial Sequence; identical to SEQ ID NO: 24020
  neuraminidase__InfluenzaA__AHC62557

SEQ ID NO: 24320 - protein, 469 aa, Artificial Sequence; identical to SEQ ID NO: 23971
  neuraminidase__InfluenzaA__AHC62569

SEQ ID NO: 24321 - protein, 469 aa, Artificial Sequence; identical to SEQ ID NO: 24020
  neuraminidase__InfluenzaA__AHC62581

SEQ ID NO: 24322 - protein, 469 aa, Artificial Sequence
  neuraminidase__InfluenzaA__AHC62593
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGNIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24323 - protein, 469 aa, Artificial Sequence; identical to SEQ ID NO: 24007
  neuraminidase__InfluenzaA__AHC62605

SEQ ID NO: 24324 - protein, 469 aa, Artificial Sequence
  neuraminidase__InfluenzaA__AHC62617
MNPNQKIITIGSVSLTISTICFFMQIAILITTVTLHFKQYEFNSPPNNQVMRCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24325 - protein, 469 aa, Artificial Sequence; identical to SEQ ID NO: 23975
  neuraminidase__InfluenzaA__AHC62629

SEQ ID NO: 24326 - protein, 469 aa, Artificial Sequence
  neuraminidase__InfluenzaA__AHC62641
MNPNQKIITIGSVSLTISTVCFFMQVAILITTVTLHFKQYEFNSPPNNQVMLCEPTIIERNITEILYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24327 - protein, 469 aa, Artificial Sequence; identical to SEQ ID NO: 23975
  neuraminidase__InfluenzaA__AHC62653

SEQ ID NO: 24328 - protein, 469 aa, Artificial Sequence; identical to SEQ ID NO: 23975
  neuraminidase__InfluenzaA__AHC62665

SEQ ID NO: 24329 - protein, 469 aa, Artificial Sequence
  neuraminidase__InfluenzaA__AHC62677
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDISSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24330 - protein, 465 aa, Artificial Sequence
  neuraminidase__InfluenzaA__AHF20560
MNPNQKILCTSATAIIIGAITVLIGIANLGLNIGLHLKPGCNCSHSQPETTNTSQTIINNYYNETNTTNIQMEERTSRNFNNLTKGLCTINSWHIYGKDNAVRIGESSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKILKWESLTGTAKHIEECSCYGERTGITCTCRDNWQGSNRPVIQIDPVAMTHTSQYICSPVLTDNPRPNDPNIGKCNDPYPGNNNNGVKGFSYLDGANTWLGRTISTASRSGYEMLKVPNALTDDRSKPIQGQTIVLNADWSGYSGSFMDYWAEGDCYRACFYVELIRGRPKEDKVWWTSNSIVSMCSSTEFLEQWNWPDGAKIEYFL

SEQ ID NO: 24331 - protein, 465 aa, Artificial Sequence; identical to SEQ ID NO: 23454
  neuraminidase__InfluenzaA__AHF20570

SEQ ID NO: 24332 - protein, 470 aa, Artificial Sequence; identical to SEQ ID NO: 16632
  neuraminidase__InfluenzaA__AHG96111

SEQ ID NO: 24333 - protein, 470 aa, Artificial Sequence; identical to SEQ ID NO: 16632
  neuraminidase__InfluenzaA__AHG96123

SEQ ID NO: 24334 - protein, 470 aa, Artificial Sequence; identical to SEQ ID NO: 16632
  neuraminidase__InfluenzaA__AHG96135

SEQ ID NO: 24335 - protein, 470 aa, Artificial Sequence; identical to SEQ ID NO: 16632
  neuraminidase__InfluenzaA__AHG96147

SEQ ID NO: 24336 - protein, 470 aa, Artificial Sequence; identical to SEQ ID NO: 16632
  neuraminidase__InfluenzaA__AHG96159

SEQ ID NO: 24337 - protein, 470 aa, Artificial Sequence; identical to SEQ ID NO: 16632
  neuraminidase__InfluenzaA__AHG96171

SEQ ID NO: 24338 - protein, 470 aa, Artificial Sequence; identical to SEQ ID NO: 16632
  neuraminidase__InfluenzaA__AHG96183

SEQ ID NO: 24339 - protein, 470 aa, Artificial Sequence; identical to SEQ ID NO: 16632
  neuraminidase__InfluenzaA__AHG96195

SEQ ID NO: 24340 - protein, 470 aa, Artificial Sequence; identical to SEQ ID NO: 16632
  neuraminidase__InfluenzaA__AHG96207

SEQ ID NO: 24341 - protein, 470 aa, Artificial Sequence; identical to SEQ ID NO: 16632
  neuraminidase__InfluenzaA__AHG96219

SEQ ID NO: 24342 - protein, 470 aa, Artificial Sequence; identical to SEQ ID NO: 16632
  neuraminidase__InfluenzaA__AHG96231

SEQ ID NO: 24343 - protein, 470 aa, Artificial Sequence; identical to SEQ ID NO: 16632
  neuraminidase__InfluenzaA__AHG96243

SEQ ID NO: 24344 - protein, 470 aa, Artificial Sequence; identical to SEQ ID NO: 16632
  neuraminidase__InfluenzaA__AHG96255

SEQ ID NO: 24345 - protein, 470 aa, Artificial Sequence; identical to SEQ ID NO: 16632
  neuraminidase__InfluenzaA__AHG96267

SEQ ID NO: 24346 - protein, 470 aa, Artificial Sequence; identical to SEQ ID NO: 16632
  neuraminidase__InfluenzaA__AHG96279

SEQ ID NO: 24347 - protein, 470 aa, Artificial Sequence; identical to SEQ ID NO: 16632
  neuraminidase__InfluenzaA__AHG96291

SEQ ID NO: 24348 - protein, 470 aa, Artificial Sequence; identical to SEQ ID NO: 16632
  neuraminidase__InfluenzaA__AHG96303

SEQ ID NO: 24349 - protein, 469 aa, Artificial Sequence; identical to SEQ ID NO: 16456
  neuraminidase__InfluenzaA__AHG96362

SEQ ID NO: 24350 - protein, 469 aa, Artificial Sequence; identical to SEQ ID NO: 16456
  neuraminidase__InfluenzaA__AHG96374

SEQ ID NO: 24351 - protein, 469 aa, Artificial Sequence; identical to SEQ ID NO: 16456
  neuraminidase__InfluenzaA__AHG96386

SEQ ID NO: 24352 - protein, 470 aa, Artificial Sequence; identical to SEQ ID NO: 16632
  neuraminidase__InfluenzaA__AHG96398

SEQ ID NO: 24353 - protein, 469 aa, Artificial Sequence; identical to SEQ ID NO: 16456
  neuraminidase__InfluenzaA__AHG96410

SEQ ID NO: 24354 - protein, 469 aa, Artificial Sequence; identical to SEQ ID NO: 16456
  neuraminidase__InfluenzaA__AHG96422

SEQ ID NO: 24355 - protein, 469 aa, Artificial Sequence; identical to SEQ ID NO: 16456
  neuraminidase__InfluenzaA__AHG96434

SEQ ID NO: 24356 - protein, 469 aa, Artificial Sequence; identical to SEQ ID NO: 16456
  neuraminidase__InfluenzaA__AHG96446

SEQ ID NO: 24357 - protein, 469 aa, Artificial Sequence; identical to SEQ ID NO: 16456
  neuraminidase__InfluenzaA__AHG96458

SEQ ID NO: 24358 - protein, 469 aa, Artificial Sequence; identical to SEQ ID NO: 16456
  neuraminidase__InfluenzaA__AHG96470

SEQ ID NO: 24359 - protein, 469 aa, Artificial Sequence; identical to SEQ ID NO: 16456
  neuraminidase__InfluenzaA__AHG96482

SEQ ID NO: 24360 - protein, 469 aa, Artificial Sequence; identical to SEQ ID NO: 16456
  neuraminidase__InfluenzaA__AHG96494

SEQ ID NO: 24361 - protein, 469 aa, Artificial Sequence; identical to SEQ ID NO: 16456
  neuraminidase__InfluenzaA__AHG96506

SEQ ID NO: 24362 - protein, 470 aa, Artificial Sequence; identical to SEQ ID NO: 16632
  neuraminidase__InfluenzaA__AHG96518

SEQ ID NO: 24363 - protein, 470 aa, Artificial Sequence; identical to SEQ ID NO: 16632
  neuraminidase__InfluenzaA__AHG96530

SEQ ID NO: 24364 - protein, 470 aa, Artificial Sequence; identical to SEQ ID NO: 16632
  neuraminidase__InfluenzaA__AHG96542

SEQ ID NO: 24365 - protein, 470 aa, Artificial Sequence; identical to SEQ ID NO: 16632
  neuraminidase__InfluenzaA__AHG96554

SEQ ID NO: 24366 - protein, 470 aa, Artificial Sequence; identical to SEQ ID NO: 16632
  neuraminidase__InfluenzaA__AHG96566

SEQ ID NO: 24367 - protein, 470 aa, Artificial Sequence; identical to SEQ ID NO: 16632
  neuraminidase__InfluenzaA__AHG96578

SEQ ID NO: 24368 - protein, 470 aa, Artificial Sequence; identical to SEQ ID NO: 16632
  neuraminidase__InfluenzaA__AHG96590

SEQ ID NO: 24369 - protein, 470 aa, Artificial Sequence; identical to SEQ ID NO: 16632
  neuraminidase__InfluenzaA__AHG96602

SEQ ID NO: 24370 - protein, 470 aa, Artificial Sequence; identical to SEQ ID NO: 16632
  neuraminidase__InfluenzaA__AHG96614

SEQ ID NO: 24371 - protein, 470 aa, Artificial Sequence; identical to SEQ ID NO: 16632
  neuraminidase__InfluenzaA__AHG96626

SEQ ID NO: 24372 - protein, 470 aa, Artificial Sequence; identical to SEQ ID NO: 16632
  neuraminidase__InfluenzaA__AHG96638

SEQ ID NO: 24373 - protein, 470 aa, Artificial Sequence; identical to SEQ ID NO: 16632
  neuraminidase__InfluenzaA__AHG96650

SEQ ID NO: 24374 - protein, 470 aa, Artificial Sequence; identical to SEQ ID NO: 16632
  neuraminidase__InfluenzaA__AHG96662

SEQ ID NO: 24375 - protein, 470 aa, Artificial Sequence; identical to SEQ ID NO: 16632
  neuraminidase__InfluenzaA__AHG96674

SEQ ID NO: 24376 - protein, 470 aa, Artificial Sequence; identical to SEQ ID NO: 16632
  neuraminidase__InfluenzaA__AHG96686

SEQ ID NO: 24377 - protein, 469 aa, Artificial Sequence; identical to SEQ ID NO: 16456
  neuraminidase__InfluenzaA__AHG96698

SEQ ID NO: 24378 - protein, 469 aa, Artificial Sequence; identical to SEQ ID NO: 16456
  neuraminidase__InfluenzaA__AHG96710

SEQ ID NO: 24379 - protein, 469 aa, Artificial Sequence; identical to SEQ ID NO: 16456
  neuraminidase__InfluenzaA__AHG96722

SEQ ID NO: 24380 - protein, 469 aa, Artificial Sequence; identical to SEQ ID NO: 16456
  neuraminidase__InfluenzaA__AHG96734

SEQ ID NO: 24381 - protein, 469 aa, Artificial Sequence; identical to SEQ ID NO: 16456
  neuraminidase__InfluenzaA__AHG96746

SEQ ID NO: 24382 - protein, 469 aa, Artificial Sequence; identical to SEQ ID NO: 16456
  neuraminidase__InfluenzaA__AHG96758

SEQ ID NO: 24383 - protein, 469 aa, Artificial Sequence; identical to SEQ ID NO: 16456
  neuraminidase__InfluenzaA__AHG96770

SEQ ID NO: 24384 - protein, 469 aa, Artificial Sequence; identical to SEQ ID NO: 16456
  neuraminidase__InfluenzaA__AHG96782

SEQ ID NO: 24385 - protein, 469 aa, Artificial Sequence; identical to SEQ ID NO: 16456
  neuraminidase__InfluenzaA__AHG96794

SEQ ID NO: 24386 - protein, 469 aa, Artificial Sequence; identical to SEQ ID NO: 16456
  neuraminidase__InfluenzaA__AHG96806

SEQ ID NO: 24387 - protein, 469 aa, Artificial Sequence; identical to SEQ ID NO: 16456
  neuraminidase__InfluenzaA__AHG96818

SEQ ID NO: 24388 - protein, 469 aa, Artificial Sequence; identical to SEQ ID NO: 16456
  neuraminidase__InfluenzaA__AHG96830

SEQ ID NO: 24389 - protein, 469 aa, Artificial Sequence; identical to SEQ ID NO: 16456
  neuraminidase__InfluenzaA__AHG96842

SEQ ID NO: 24390 - protein, 469 aa, Artificial Sequence; identical to SEQ ID NO: 16456
  neuraminidase__InfluenzaA__AHG96854

SEQ ID NO: 24391 - protein, 469 aa, Artificial Sequence; identical to SEQ ID NO: 16456
  neuraminidase__InfluenzaA__AHG96866

SEQ ID NO: 24392 - protein, 469 aa, Artificial Sequence; identical to SEQ ID NO: 16456
  neuraminidase__InfluenzaA__AHG96878

SEQ ID NO: 24393 - protein, 469 aa, Artificial Sequence; identical to SEQ ID NO: 16456
  neuraminidase__InfluenzaA__AHG96890

SEQ ID NO: 24394 - protein, 469 aa, Artificial Sequence; identical to SEQ ID NO: 16456
  neuraminidase__InfluenzaA__AHG96902

SEQ ID NO: 24395 - protein, 469 aa, Artificial Sequence; identical to SEQ ID NO: 16456
  neuraminidase__InfluenzaA__AHG96914

SEQ ID NO: 24396 - protein, 469 aa, Artificial Sequence; identical to SEQ ID NO: 16456
  neuraminidase__InfluenzaA__AHG96926

SEQ ID NO: 24397 - protein, 469 aa, Artificial Sequence; identical to SEQ ID NO: 16456
  neuraminidase__InfluenzaA__AHG96938

SEQ ID NO: 24398 - protein, 469 aa, Artificial Sequence; identical to SEQ ID NO: 16456
  neuraminidase__InfluenzaA__AHG96950

SEQ ID NO: 24399 - protein, 469 aa, Artificial Sequence; identical to SEQ ID NO: 16456
  neuraminidase__InfluenzaA__AHG96962

SEQ ID NO: 24400 - protein, 469 aa, Artificial Sequence; identical to SEQ ID NO: 16456
  neuraminidase__InfluenzaA__AHG96974

SEQ ID NO: 24401 - protein, 469 aa, Artificial Sequence; identical to SEQ ID NO: 16456
  neuraminidase__InfluenzaA__AHG96986

SEQ ID NO: 24402 - protein, 469 aa, Artificial Sequence; identical to SEQ ID NO: 16456
  neuraminidase__InfluenzaA__AHG96998

SEQ ID NO: 24403 - protein, 469 aa, Artificial Sequence; identical to SEQ ID NO: 16456
  neuraminidase__InfluenzaA__AHG97010

SEQ ID NO: 24404 - protein, 469 aa, Artificial Sequence; identical to SEQ ID NO: 16456
  neuraminidase__InfluenzaA__AHG97022

SEQ ID NO: 24405 - protein, 469 aa, Artificial Sequence; identical to SEQ ID NO: 16456
  neuraminidase__InfluenzaA__AHG97034

SEQ ID NO: 24406 - protein, 469 aa, Artificial Sequence; identical to SEQ ID NO: 16456
  neuraminidase__InfluenzaA__AHG97046

SEQ ID NO: 24407 - protein, 469 aa, Artificial Sequence
  neuraminidase__InfluenzaA__AHH00872
MNPNQKIITIGSVSLTIATICFLMQIAILVTTVTLHFKQYECNPPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVIMTDGSASGKADTKILFIEEGKIVHTSPLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKSRSGYETFKVIEGWSKPNSKLQINRQVIIDRGNRSGYSGIFSVEGKSCINRCFYVELIRGRKQETEVLWTSNSIVVFCGTSGTYGTGSWPDGADLNLMPI

SEQ ID NO: 24408 - protein, 471 aa, Artificial Sequence
  neuraminidase__InfluenzaA__AHI43497
MNPNQKLFALSGVAIALSILNLLIGISNVGLNISLHLKGKGPKQEENLTCTTINQNNTTVVENTYVNNTTIITKETDWNTPSYLLLNKSLCNVEGWVVIAKDNAIRFGESEQIIVTREPYVSCDPTGCKMYALHQGTTIRNKHSNGTIHDRTAFRGLISTPLGTPPTVSNSGFMCVGWSSTTCHDGIGRMTICIQGNNDNATATVYYNGRLTTTIKTWARNILRTQESECVCHNGTCAVVMTDGSASSQAYTKVMYFHKGLVIKEEALRGSARHIEECSCYGHSQRVTCVCRDNWQGANRPIIEIDMNTLEHTSRYVCTGILTDTSRPGDKSSGDCSNPITGSPGAQGVKGFGFLNGDNTWLGRTISPRSRSGFEMLKIPNAGTDPNSRIAERQEIVDNNNWSGYSGSFIDYWNNNSECYNPCFYVELIRGRPEEAKYVWWTSNSLIALCGSPFPVGSGSFPDGAQIQYFS

SEQ ID NO: 24409 - protein, 469 aa, Artificial Sequence
  neuraminidase__InfluenzaA__AHJ57439
MNPNQKIITIGSVSLIISTICFFMQVAILLTTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 24410 - protein, 469 aa, Artificial Sequence
  neuraminidase__InfluenzaA__AHJ57440
MNPNQKIITIGSVSLIISTICFFMQIAILITTVTLHFKQYEFNSPPNNQMMLCEPTIIERNITEIVYLTNTTIEKEICPKPAEYRNWSKPQCDITGFAPFSKDNSIRLSAGGDIWVTREPYVSCDPDKCYQFALGQGTTLNNGHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADINLMPI

SEQ ID NO: 24411 - protein, 469 aa, Artificial Sequence
  neuraminidase__InfluenzaA__AHJ57441
MNPNQKIITIGSVSLIISTICFFMQIAILITTVTLHFKQYEFNSPPNNQVMLCEPTIIERNKTEIVYLTNTTIEKEICPKPAEYRNWSKPQCDITGFAPFSKDNSIRLSAGGDIWVTREPYVSCDPDKCYQFALGQGTTLNNVHSNNTVHDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 24412 - protein, 470 aa, Artificial Sequence
  neuraminidase__InfluenzaA__AHJ57654
MNPNQKITCISATGMTLSVVSLLIGIANLGLNIGLHYKVSDSTNINIPNMNETSPTTTIINNHPQNNFTNITNIIMNKNEEGNFLNLTKPLCEVNSWHILSKDNAIRIGENAHILVTREPYLSCDPQGCRMFALSQGTTLRGRHANGTIHDRSPFRALISWEMGQAPSPYNARVECIGWSSTSCHDGISRMSICISGPNNNASAVVWYGGRPVTEIPSWAGNILRTQESECVCHGGICPVVMTDGPANNRAETKIIYFKEGKVQKIEELKGNAQHIEECSCYGASGMIKCICRDNWKGANRPVITIDPEMMTHTSKYLCSKILTDTSRPNDPTNGNCDAPITGGSPDPGVKGFAFLDGENSWLGRTISKDSRSGYEMLKIPNAETDTQSGAISHQIIVNNQNWSGYSGAFIDYWANKECFNPCFYVELIRGRPKESSVLWTSNSIVALCGSRERLGSWSWHDGAEIIYFK

SEQ ID NO: 24413 - protein, 469 aa, Artificial Sequence
  neuraminidase__InfluenzaA__AHJ57666
MNPNQKIITIGSVSLTIATVSFLMQIAILTTTVTLHFKHNECNMPPKNQVMSCEPIIIERNITEIVYLNNTTVEKEICPKVVEYRNWSKPQCKITGFAPFSKDNSIRLSAGGDIWVTREPYVSCGLGKCYQFALGQGTTLDNSHSNGTIHDRIPHRTLLMNELGVPFHLGTKQVCIAWSSSSCHDGRAWLHICITGDDRNATASFIYDGMLVDSIGSWSKNILRTQESECVCINGTCAVVMTDGSASGVADTRILFIREGKIVHISPLSGSAQHIEECSCYPRYPDVRCVCRDNWKGSNRPVIDINMADYSIDSNYVCSGLVGDTPRNDDNSSSSNCRDPNNERGNPGVKGWAFDDGNDVWMGRTINRDSRSGYETFRVIGGWTTANSKSQINRQVIVDNNNWSGYSGVFSVEGKSCINRCFYVELIKGRPQEPRVWWTSNSIVVFCGTSGTYGTGSWPDGANINFMPI

SEQ ID NO: 24414 - protein, 470 aa, Artificial Sequence
  neuraminidase__InfluenzaA__AHJ57677
MNPNQKITCISATGMTLSVVSMLIGIANLGLNIGLHYKVSDSTNINIPNMNETSPTTTVINNHPQNNFTNITNIIVNKNEEENFLNLTKPLCEVNSWHILSKDNAIRIGENAHILVTREPYLSCDPQGCRMFALSQGTTLRGQHANGTIHDRSPFRALISWEMGQAPSPYNARVECIGWSSTSCHDGISRMSICISGPNNNASAVVWYGGRPVTEIPSWAGNILRTQESECVCHGGICPVVMTDGPANNRAETKIIYFKEGKIQKVEELKGNAQHIEECSCYGASGMIKCICRDNWKGANRPVITIDPEMMTHTSKYLCSKILTDTSRPNDPTNGNCDAPITGGSPDPGVKGFAFLDGENSWLGRTISKDSRSGYEMLKVPNAETDTQSGAISHQMIVNNQNWSGYSGAFIDYWAKKECFNPCFYVELIRGRPKESSVLWTSNSIVALCGSRERLGSWSWHDGAEIIYFK

SEQ ID NO: 24415 - protein, 470 aa, Artificial Sequence
  neuraminidase__InfluenzaA__AHJ57689
MNPNQKITCISATGMTLSVVSMLIGIANLGLNIGLHYKVSDSTNINIPKMNETSPTTTIINNHPQNNFTNITNIIVNKNEEENFLNLTKPLCEVNSWHILSKDNAIRIGENAHILVTREPYLSCDPQGCRMFALSQGTTLRGQHANGTIHDRSPFRALISWEMGQAPSPYNARVECIGWSSTSCHDGISRMSICISGPNNNASAVVWYGGRPVTEIPSWAGNILRTQESECVCHGGICPVVMTDGPANNRAETKIIYFKEGKIQKIEELKGNAQHIEECSCYGASGMIKCICRDNWKGANRPVITIDPEMMTHTSKYLCSKILTDTSRPNDPTNGNCDAPITGGSPDPGVKGFAFLDGENSWLGRTISKDSRSGYEMLKVPNAETDTQSGAISHQIIVNNQNWSGYSGAFIDYWANKECFNPCFYVELIRGRPKESSVLWTSNSIVALCGSRERLGSWSWHDGAEIIYFK

SEQ ID NO: 24416 - protein, 470 aa, Artificial Sequence
  neuraminidase__InfluenzaA__AHJ57700
MNPNQKITCISATGMTLSVVSLLIGIANLGLNIGLHYKVSDSTNINIPNMNETSPTTTIINNHPQNNFTNITNIIMNKNEEGNFLNLTKPLCEVNSWHILSKDNAIRIGENAHILVTREPYLSCDPQGCRMFALSQGTTLRGRHANGTIHDRSPFRALISWEMGQAPSPYNARVECIGWSSTSCHDGISRMSICISGPNNNASAVVWYGGRPVTEIPSWAGNILRTQESECVCHGGICPVVMTDGPANNRAETKIIYFKEGKVQKIEELKGNAQHIEECSCYGASGMIKCICRDNWKGANRPVITIDPEMMTHTSKYLCSKILTDTSRPNDPTNGNCDAPITGGSPDPGVKGFAFLDGENSWLGRTISKDSRSGYEMLKVPNAETDTQSGAISHQIIVNNQNWSGYSGAFIDYWANKECFNPCFYVELIRGRPKESSVLWTSNSIVALCGSRERLGSWSWHDGAEIIYFK

SEQ ID NO: 24417 - protein, 469 aa, Artificial Sequence
  neuraminidase__InfluenzaA__AHJ57710
MNPNQKIITIGSVSLTIATVSFLMQIAILTTTVTLHFKHNECNMPPKNQVMSCEPIIIERNITEIVYLNNTTVEKEICPKVVEYRNWSKPQCKITGFAPFSKDNSIRLSAGGDIWVTREPYVSCGLGKCYQFALGQGTTLDNSHSNGTIHDRIPHRTLLMNELGVPFHLGTKQVCIAWSSSSCHDGRAWLHICITGDDRNATASFIYDGMLVDSISSWSKNILRTQESECVCINGTCAVVMTDGSASGVADTRILFIREGKIVHISPLSGSAQHIEECSCYPRYPDVRCVCRDNWKGSNRPVININMADYSIDSNYVCSGLVGDTPRNDDNSSSSNCRDPNNERGNPGVKGWAFDDGNDVWMGRTINRDSRSGYETFRVIGGWTTANSKSQINRQVIVDNNNWSGYSGVFSVEGKSCINRCFYVELIRGRPQEPRVWWTSNSIVVFCGTSGTYGTGSWPDGANINFMPI

SEQ ID NO: 24418 - protein, 469 aa, Artificial Sequence
  neuraminidase__InfluenzaA__AHJ57734
MNPNQKIITIGSVSLTIATVSFLMQIAILTTTVTLHFKHNECNMPPKNQVMSCEPIIIERNITEIVYLNNTTVEKEICPKVAEYRNWSKPQCKITGFAPFSKDNSIRLSAGGDIWVTREPYVSCGLGKCYQFALGQGTTLDNSHSNGTIHDRIPHRTLLMNELGVPFHLGTKQVCIAWSSSSCHDGRAWLHICITGDDRNATASFIYDGMLVDSIGSWSKNILRTQESECVCINGTCAVVMTDGSASGVADTRILFIREGKIVHISPLSGSAQHIEECSCYPRYPDVRCVCRDNWKGSNRPVININMADYSIDSNYVCSGLVGDTPRNDDNSSSSNCRDPNNERGNPGVKGWAFDDGNDVWMGRTINRDSRSGYETFRVIGGWTTANSKSQINRQVIVDNNNWSGYSGVFSVEGKSCINRCFYVELIRGRPQEPRVWWTSNSIVVFCGTSGTYGTGSWPDGANINFMPI

SEQ ID NO: 24419 - protein, 459 aa, Artificial Sequence
  neuraminidase__InfluenzaA__AHJ57746
MNPNQKIITIGSVSITIAAVCFLMQIAILATTVTLHFKQNECNIPSKNHVIPCEPIIIERNITEVEIRPKVAEYRDWSKPQCQITGFAPFSKDNSIRLSAGGNIWVTREPYVSCGPDKCYQFALGQGTTLGNGHSNGTIHDKIPHRTLLMNELGVPFHLGTKQVCIAWSSSSCHDGRAWLHVCVTGDDRNATASFIYDGMLVDSIASWSQNILRTQESECVCINGTCTVVMTDGSASGVADTRILFIREGKIVHISPLSGSAQHIEECSCYPRHSDVRCVCRDNWKGSNRPVVDINMTDYSIDSSYVCSGLVGDTPRNDDSSSSSNCRDPNNERGNPGVKGWAFDDGDDVWMGRTISRDSRSGYETFRVIGGWTTANSKSQINRQVIVDNNNWSGYSGVFSVEGKSCINRCFYVELIRGRPQETRVWWTSNSIVVFCGTSGTYGTGSWPDGANINFMPI

SEQ ID NO: 24420 - protein, 469 aa, Artificial Sequence
  neuraminidase__InfluenzaA__AHJ57758
MNPNQKIITVGSVSLAIATICLLMQIAILATTVTLHFKQNECNIPSKNQVMPCEPIIIERNITEVVYLNNTIIEKEICPKVVEYRNWSKPQCQITGFAPFSKDNSIRLSAGGDIWVTREPYVSCSPSKCYQFALGQGTTLDNSHSNGTIHDRIPHRTLLMNELGVPFHLGTKQVCIAWSSSSCHDGRAWLHVCITGDDRNATASFIYNGMLVDSISSWSRNILRTQESECVCINGTCTVIMTDGSASGVADTRILFIREGNIVHVSPLSGSAQHIEECSCYPRYPDVRCVCRDNWKGSNRPVVDINMADYSIDSHYVCSGLVGDTPRNDDSSSSSNCKDPNNERGNPGVKGWAFDDGNDVWMGRTISRDSRSGYETFRVIGGWTTANSKSQINRQVIVDNNNWSGYSGVFSVEGKSCINRCFYVELIRGRPQETRVWWTSNSIVVFCGTSGTYGTGSWPDGANINFMPI

SEQ ID NO: 24421 - protein, 466 aa, Artificial Sequence
  neuraminidase__InfluenzaA__AHJ57770
MNPNQKIIAIGSVSLTIAIICFLMQIAILTTTMTLHFKQNECSNPSNNQVVPCEPIIIERNTVHLNSTTIEKEICPKVVEYKNWSKPQCQITGFAPFSKDNSIRLSAGGDIWVTREPYVSCSLGKCYQFALGQGTTLKNKHSNGTTHDRIPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRILFIREGKIINISPLSGSAQHVEECSCYPRYPEVRCVCRDNWKGSNRPVLYINMADYSVESSYVCSGLVGDTPRNDDSSSSSNCRDPNNERGAPGVKGWAFDDGNDVWMGRTIKNDSRSGYETFRVVNGWTTANSKSQINRQVIVDSENWSGYSGIFSVEGKNCINRCFYVELIRGRPQEPRVWWTSNSIIVFCGTSGTYGTGSWPDGANINFLPI

SEQ ID NO: 24422 - protein, 469 aa, Artificial Sequence
  neuraminidase__InfluenzaA__AHJ57782
MNPNQKIIIIGSVSLTIATVCFLMQIAILATTVTLHFKQNECNIPSKNQVVPCEPIIIERNITEVVYLNNTTIEKEICPAVVEYRNWSKPQCQIKGFAPFSKDNSIRLSAGGDMWVTREPYVSCSPSKCYQFALGQGTTLDNNHSNGTIHDRIPHRTLLMNELGVPFHLGTKQVCIAWSSSSCHDGKAWLHVCVTGDDRNATASFIYDGMLVDSIGSWSQNILRTQESECVCINGTCTVVMTDGSASGIADTRILFVREGKIVHISPLSGSAQHIEECSCYPRYPDVRCVCRDNWKGSNRPIVDINMADYSIGSSYVCSGLVGDTPRNDDRFSSSNCRDPNSERGNPGVKGWAFDDGDDVWMGRTISRDSRSGYETFRVIGGWTTANSKSQINRQVIVDNNNWSGYSGVFSVEGKSCINRCFYVELIRGRPQETRVWWTSNSIVVFCGTSGTYGTGSWPDGANINFMPI

SEQ ID NO: 24423 - protein, 469 aa, Artificial Sequence
  neuraminidase__InfluenzaA__AHJ57794
MNPNQKIITVGSVSLAIATICFLMQIAILATTVTLHFKQNECNIPSKNQVMPCEPIIIERNITEVVYLNNTIIEKEICPKVVEYRNWSKPQCQITGFAPFSKDNSIRLSAGGDIWVTREPYVSCSPSKCYQFALGQGTTLDNSHSNGTIHDRIPHRTLLMNELGVPFHLGTKQVCIAWSSSSCHDGRAWLHVCITGDDRNATASFIYNGMLVDSISSWSRNILRTQESECVCINGTCTVIMTDGSASGVADTRILFIREGNIVHVSPLSGSAQHIEECSCYPRYPDVRCVCRDNWKGSNRPVVDINMADYSIDSHYVCSGLVGDTPRNDDSSSSSNCKDPNNERGNPGVKGWASDDGHDVWMGRTIGRDSRSGYETFRVIGGWTTANSKSQINRQVIVDNNNWSGYSGVFSVEGKSCINRCFYVELIRGRPQETRVWWTSNSIVVFCGTSGTYGTGSWPDGANINFMPI

SEQ ID NO: 24424 - protein, 470 aa, Artificial Sequence
  neuraminidase__InfluenzaA__AHJ57806
MNPNQKITCISATGMTLSVVSLLTGIANLGLNIGLHYKVSDSTNISIPNMNEASPTTTIINNHPQNNFTNITNIIMNKNEEGNFLNLTKPLCEVNSWHILSKDNAIRIGENAHILVTREPYLSCDPQGCRMFALSQGTTLRGRHANGTIHDRSPFRALISWEMGQAPSPYNARVECIGWSSTSCHDGISRMSICISGPNNNASAVVWYGGRPVTEIPSWAGNILRTQESECVCHGGICPVVMTDGPANNRAETKIIYFKEGKIQKIEELKGNAQHIEECSCYGASGMIKCICRDNWKGANRPVITIDPEMMTHTSKYLCSKILTDTSRPNDPTNGNCDAPITGGSPDPGVKGFAFLDGKNSWLGRTISKDSRSGYEMLKVPNAETDTQSGAISHQIIVNNQNWSGYSGAFIDYWANKECFNPCFYVELIRGRPKESSVLWTSNSIVALCGSRERLGSWSWHDGAEIIYFK

SEQ ID NO: 24425 - protein, 459 aa, Artificial Sequence
  neuraminidase__InfluenzaA__AHJ57818
MNPNQKITCISATGVTLSVVSLLIGIANLGLNIGLHYKVSDSPTINIPNMNETNPITTNITNIIVNKNEEGTFLNLTKPLCEVNSWHILSKDNAIRIGEDAHILVTREPYLSCDPQGCRMFALSQGTTLRGRHANGTIHDRSPFRALISWEMGQAPSPYNTRVECIGWSSTSCHDGISRMSICISGPNNNASAVVWYRGRPVTEIPSWAGNILRTQESECVCHKGICPVVMTDGPANNKAATKIIYFKEGKIQKIEELQGNAQHIEECSCYGAAGMIKCVCRDNWKGANRPIITIDPEMMTHTSKYLCSKILTDTSRPNDPTDGNCDAPITGGSPDPGVKGFAFLEGENSWLGRTISKDSRSGYEMLKVPNAETDTQSGAISHQMIVNNQNWSGYSGAFIDYWANKECFNPCFYVELIRGRPKESSVLWTSNSIVALCGSRERLGSWSWHDGAEIIYFK

SEQ ID NO: 24426 - protein, 469 aa, Artificial Sequence
  neuraminidase__InfluenzaA__AHJ57830
MNPNQKIITIGSVSLTIATVSFLMQIAILTTTVTLHFKHNECNMPPKNQVMSCEPIIIERNITEIVYLNNTTIEKEICPKVVEYRNWSKPQCKITGFAPFSKDNSIRLSAGGDIWVTREPYVSCGLGKCYQFALGQGTTLDNSHSNGTIHDRIPHRTLLMNELGVPFHLGTKQVCIAWSSSSCHDGRAWLHICITGDDRNATASFIYDGMLVDSIGSWSKNILRTQESECVCINGTCAVVMTDGSASGVADTRILFIREGKIVHISPLSGSAQHIEECSCYPRYPDVRCVCRDNWKGSNRPVIDINMADYSIDSNYVCSGLVGDTPRNDDNSSSSNCRDPNNERGNPGVKGWAFDDGNDVWMGRTINRDSRSGYETFRVIGGWTTANSKSQINRQVIVDNNNWSGYSGVFSVEGKSCINRCFYVELIRGRPQEPRVWWTSNSIVVFCGTSGTYGTGSWPDGANINFMPI

SEQ ID NO: 24427 - protein, 470 aa, Artificial Sequence
  neuraminidase__InfluenzaA__AHJ57842
MNPNQKITCISATGMTLSVVSMLIGIANLGLNIGLHYKVSDSTNINIPKMNETNPTTTIINNHPQNNFTNITNIIVNKNEEENFLNLTKPLCEVNSWHILSKDNAIRIGENAHILVTREPYLSCDPQGCRMFALSQGTTIRGQHANGTIHDRSPFRALISWEMGQAPSPYNARVECIGWSSTSCHDGISRMSICISGPNNNASAVVWYGGRPVTEIPSWAGNILRTQESECVCHGGICPVVMTDGPANNRAETKIIYFKEGKIQKIEELKGNAQHIEECSCYGASGMIKCICRDNWKGANRPVITIDPEMMTHTSKYLCSKILTDTSRPNDPTNGNCDAPITGGSSDPGVKGFAFLDGENSWLGRTISKDSRSGYEMLKVPNAETDTQSGAISHQIIVNNQNWSGYSGAFIDYWANKECFNPCFYVELIRGRPKESSVLWTSNSIVALCGSRERLGSWSWHDGAEIIYFK

SEQ ID NO: 24428 - protein, 470 aa, Artificial Sequence
  neuraminidase__InfluenzaA__AHJ57853
MNPNQKITCISATGMTLSVVSLLIGIANLGLNVGLHYKVNDPTNINIPNMNETSPTTTIINNHPQNNFTNITNIIVNKNEEENFLNLTKPLCEVNSWHILSKDNAIRIGENAHILVTREPYLSCDPQGCRMFALSQGTTLRGQHANGTIHDRSPFRALISWEMGQAPSPYNARVECIGWSSTSCHDGISRMSICISGPNNNASAVVWYGGRPVTEIPSWAGNILRTQESECVCHGGICPVVMTDGPANNRAETKIIYFKEGKIQKIEELKGNAQHIEECSCYGASGMIKCICRDNWKGANRPVITIDPEMMTHTSKYLCSKILTDTSRPNDPTNGNCDAPITGGSPDPGVKGFAFLDGENSWLGRTISKDSRSGYEMLKVPNAETDTQSGAISHQMIVNNQNWSGYSGAFIDYWANKECFNPCFYVELIRGRPKESSVLWTSNSIVALCGSRERLGSWSWHDGAEIIYFK

SEQ ID NO: 24429 - protein, 470 aa, Artificial Sequence
  neuraminidase__InfluenzaA__AHJ57865
MNPNQKITCISATGMTLSVVSMLIGIANLGLNIGLHYKVSDSTNINIPKMNETNPTTTIINNHPQNNFTNITNIIVNKNEEENFLNLTKPLCEVNSWHILSKDNAIRIGENAHILVTREPYLSCDPQGCRMFALSQGTTLRGRHANGTIHDRSPFRALISWEMGQAPSPYNARVECIGWSSTSCHDGISRMSICISGPNNNASAVVWYGGRPVTEIPSWAGNILRTQESECVCHGGICPVVMTDGPANNRAETKIIYFKEGKIQKIEELKGNAQHIEECSCYGASGMIKCICRDNWKGANRPVITIDPEMMTHTSKYLCSKILTDTSRPNDPTNGNCDAPITGGSPDPGVKGFAFLDGENSWLGRTISKDSRSGYEMLKVPNAETDTQSGAISHQMIVNNQNWSGYSGAFIDYWANKECFNPCFYVELIRGRPKESSVLWTSNSIVALCGSRERLGSWSWHDGAEIIYFK

SEQ ID NO: 24430 - protein, 470 aa, Artificial Sequence
  neuraminidase__InfluenzaA__AHJ57876
MNPNQKITCISATGMTLSVVSLLIGIANLGLNIGLHYKVSDSTNINIPNMNETSPTTTIINNHPQNNFTNITNIIMNKNEEGNFLNLTKPLCEVNSWHILSKDNAIRIGENAHILVTREPYLSCDPQGCRMFALSQGTTLRGRHANGTIHDRSPFRALISWEMGQAPSPYNARVECIGWSSTSCHDGKSRMSICISGPNNNASAVVWYGGRPITEIPSWAGNILRTQESECVCHGGICPVVMTDGPANNRAETKIIYFKEGKVQKIEELKGNAQHIEECSCYGASGMIKCICRDNWKGANRPVITIDPEMMTHTSKYLCSKILTDTSRPNDPTNGNCDAPITGGSPDPGVKGFAFLDGENSWLGRTISKDSRSGYEMLKVPNAETDTQSGAISHQIIVNNQNWSGYSGAFIDYWANKECFNPCFYVELIRGRPKESSVLWTSNSIVALCGSRERLGSWSWHDGAEIIYFK

SEQ ID NO: 24431 - protein, 470 aa, Artificial Sequence
  neuraminidase__InfluenzaA__AHJ57888
MNPNQKITCISATGMTLSVVSMLIGIANLGLNIGLHYKVSDSTNINIPNMNETSPTTTITNNHPQNNFTNITNIIVSKNEEENFLNLTKPLCEVNSWHILSKDNAIRIGENAHILVTREPYLSCDPQGCRMFALSQGTTLRGQHANGTIHDRSPFRALISWEMGQAPSPYNARVECIGWSSTSCHDGISRMSICISGPNNNASAVVWYGGRPVTEIPSWAGNILRTQESECVCHGGICPVVMTDGPANNRAETKIIYFKEGKIQKIEELKGNAQHIEECSCYGASGMIKCICRDNWKGANRPVITIDPEMMTHTSKYLCSKILTDTSRPNDPTNGNCDAPITGGSPDPGVKGFAFLDGENSWLGRTISKDSRSGYEMLKVPNAETDTQSGAISHQMIVNNQNWSGYSGAFIDYWANKECFNPCFYVELIRGRPKESSVLWTSNSIVALCGSRERLGSWSWHDGAEIIYFK

SEQ ID NO: 24432 - protein, 470 aa, Artificial Sequence
  neuraminidase__InfluenzaA__AHJ57900
MNPNQKITCISATGMTLSVVSLLIGIANLGLNIGLHYKVSDSTNINIPNMNETSPTATIINNHPQNNFTNITNIIVNKNEEENFFNLAKPLCEVNSWHILSKDNAIRIGENAHILVTREPYLSCDPQGCRMFALSQGTTLRGQHANGTIHDRSPFRALISWEMGQAPSPYNARVECIGWSSTSCHDGISRMSICISGPNNNASAVVWYGGRPVTEIPSWAGNILRTQESECVCHGGICPVVMTDGPANNRAETKIIYFKEGKIQKIEDLKGNAQHIEECSCYGASGMIKCICRDNWKGANRPVITIDPEMMTHTSKYLCSKILTDTSRPNDPTNGNCDAPITGGSPDPGVKGFAFLDGENSWLGRTISKDSRSGYEMLKVPNAETDTQSGAISHQMIVNNQNWSGYSGAFIDYWANKECFNPCFYVELIRGRPKESSVLWTSNSIVALCGSRERLGSWSWHDGAEIIYFK

SEQ ID NO: 24433 - protein, 470 aa, Artificial Sequence
  neuraminidase__InfluenzaA__AHJ57911
MNPNQKITCISATGVTLSVVSLLIGIANLGLNIGLHYKVSDSSNINIPNMNETNPTTTIINNHTQNNFKNITNIIVNKNEEGIFLNLTKPLCEVNSWHILSKDNAIRIGEDAHILVTREPYLSCDPQGCRMFALSQGTTLRGRHANGTIHDRSPFRALISWEMGQAPSPYNARVECIGWSSTSCHDGISRMSICISGPNNNASAVVWYRGRPVTEIPSWAGNILRTQESECVCHKGICPVVMTDGPANNRAATKIIYFKEGKIQKIEELKGNAQHIEECSCYGAAGMIKCICRDNWRGANRPVITIDPEMMTHTSKYLCSKILTDTSRPNDPTNGNCDAPITGGSPDPGVKGFAFLDGENSWLGRTISKDSRSGYEMLKVPNAETDTQSGSTSYQIIVNNQNWSGYSGAFIDYWANKECFNPCFYVELIRGRPKESSVLWTSNSIVALCGSRERLGSWSWHDGAEIIYFK

SEQ ID NO: 24434 - protein, 469 aa, Artificial Sequence
  neuraminidase__InfluenzaA__AHJ57923
MNPNQKIITVGSVSLAIATICFLMQIAILATTVTLHFKQNECNIPSKNQVMPCEPIIIERNITEVVYLNNTIIEKEICPKVVEYRNWSKPQCQITGFAPFSKDNSIRLSAGGDIWVTREPYVSCSPSKCYQFALGQGTTLDNSHSNGTIHDRIPHRTLLMNELGVPFHLGTKQVCIAWSSSSCHDGRAWLHVCITGDDRNATASFIYNGMLVDSISSWSRNILRTQESECVCINGTCTVIMTDGSASGVADTRILFIREGKIVHVSPLSGSAQHIEECSCYPRYPDVRCVCRDNWKGSNRPVVDINMADYSIDSHYVCSGLVGDTPRNDDSSSSSNCKDPNNERGNPGVKGWAFDDGNDVWMGRTISRDSRSGYETFRVIGGWTTANSKSQINRQVIVDNNNWSGYSGVFSVEGKSCINRCFYVELIRGRPQETRVWWTSNSIVVFCGTSGTYGTGSWPDGANINFMPI

SEQ ID NO: 24435 - protein, 459 aa, Artificial Sequence
  neuraminidase__InfluenzaA__AHJ57935
MNPNQKITCISATGVTLSVVSLLIGIANLGLNIGLHYKVSDSPTINIPNMNETNPTTTNITNIIVNKNEEGTFLNLTKPLCEVNSWHILSKDNAIRIGEDAHILVTREPYLSCDPQGCRMFALSQGTTLRGRHANGTIHDRSPFRALISWEMGQAPSPYNTRVECIGWSSTSCHDGISRMSICISGPNNNASAVVWYRGRPVTEIPSWAGNILRTQESECVCHKGICPVVMTDGPANNKAATKIIYFKEGKIQKIEELQGNAQHIEECSCYGAAGMIKCVCRDNWKGANRPIITIDPEMMTHTSKYLCSKILTDTSRPNDPTNGNCDAPITGGSPDPGVKGFAFLDGENSWLGRTISKDSRSGYEMLKVPNAQTDTQSGPTSYQLIVNNQNWSGYSGAFIDYWANKECFNPCFYVELIRGRPKESNVLWTSNSMVALCGSRERLGSWSWHDDAEIIYFK

SEQ ID NO: 24436 - protein, 469 aa, Artificial Sequence
  neuraminidase__InfluenzaA__AHJ57946
MNPNQKIITIGSVSLTIATVSFLMQIAILTTTVTLHFKHNECNMPPKNQVMSCEPIIIERNITEIVYLNNTTVEKEICPKVVEYRNWSKPQCKITGFAPFSKDNSIRLSAGGDIWVTREPYVSCGLGKCYQFALGQGTTLDNSHSNGTIHDRIPHRTLLMNELGVPFHLGTKQVCIAWSSSSCHDGRAWLHICITGDDRNATASFIYDGMLVDSIGSWSKNILRTQESECVCINGTCAVVMTDGSASGVADTRILFIREGKIVHISPLSGSAQHIEECSCYPRYPDVRCVCRDNWKGSNRPVIDINMADYSIDSHYVCSGLVGDTPRNDDNSSSSNCRDPNNERGNPGVKGWAFDDGNDVWMGRTINRDSRSGYETFRVIGGWTTANSKSQINRQVIVDNNNWSGYSGVFSVEGKSCINRCFYVELIRGRPQEPRVWWTSNSIVVFCGTSGTYGTGSWPDGANINFMPI

SEQ ID NO: 24437 - protein, 469 aa, Artificial Sequence
  neuraminidase__InfluenzaA__AHJ57957
MNPNQKIITIGSVSLTIATVSFLMQIAILTTTVTLHFKQNECNMPPKNQVMSCEPIIIERNITEIVYLNNTTVEKEICPKVVEYRNWSKPQCKITGFAPFSKDNSIRLSAGGDIWVTREPYVSCGLGKCYQFALGQGTTLDNSHSNGTIHDRIPHRTLLMNELGVPFHLGTKQVCIAWSSSSCHDGRAWLHICITGDDRNATASFIYDGMLVDSIGSWSKNILRTQESECVCINGTCAVVMTDGSASGVADTRILFIREGKIVHISPLSGSAQHIEECSCYPRYPDVRCVCRDNWKGSNRPVIDINMADYSIDSNYVCSGLVGDTPRNDDNSSSSNCRDPNNERGNPGVKGWAFDYGNDVWMGRTINRDSRSGYETFRVIGGWTTANSKSQINRQVIVDNNNWSGYSGVFSVEGKSCINRCFYVELIRGRPQEPRVWWTSNSIVVFCGTSGTYGTGSWPDGANINFMPI

SEQ ID NO: 24438 - protein, 469 aa, Artificial Sequence
  neuraminidase__InfluenzaA__AHJ57968
MNPNQKIITVGSVSLAIATICLLMQIAILATTVTLHFKQNECNIPSKNQVMPCEPIIIERNITEVVYLNNTIIEKEICPKVVEYRNWSKPQCQITGFAPFSKDNSIRLSAGGDIWVTREPYVSCSPSKCYQFALGQGTTLDNSHSNGTIHDRIPHRTLLMNELGVPFHLGTKQVCIAWSSSSCHDGRAWLHVCITGDDRNATASFIYNGMLVDSISSWSRNILRTQESECVCINGTCTVIMTDGSASGVADTRILFIREGKIVHISPLSGSAQHIEECSCYPRYPDVRCVCRDNWKGSNRPVIDINMADYSIDSNYVCSGLVGDTPRNDDNSSSSNCRDPNNERGNPGVKGWAFDDGNDVWMGRTINRDSRSGYETFRVIGGWTTANSKSQINRQVIVDNNNWSGYSGVFSVEGKSCINRCFYVELIRGRPQETRVWWTSNSIVVFCGTSCTYGTGSWPDGANINFMPI

SEQ ID NO: 24439 - protein, 470 aa, Artificial Sequence
  neuraminidase__InfluenzaA__AHJ57980
MNPNQKNTCISAIGMTLSVVSLLIGVADLGLNIGLHYKVSDSSNINIPNMNETNPTTTIINNNPQNNFTNITNIIVNKNEEEKFLNLTKPLCEVNSWHILSKDNAIRIGEDAHILVTREPYLSCDPQGCRMFALSQGTTLRGRHANGTIHDRSPFRALISWEMGQAPSPYNARVECIGWSSTSCHDGISRMSICISGPNNNASAVVWYGGRPVTEIPSWAGNILRTQESECVCHKGICPVVMTDGPANNRAATKIIYFKEGKIQKIEELKGNAQHIEECSCYGAAGMIKCICRDNWKGANRPVITIDPEMMTHTSKYLCSKILTDTSRPNDPTSGNCDAPITGGSPDPGVKGFAFLDGENSWLGRTISKDSRSGYEMLKVPNAETDTQSGPISYQTIVNNQNWSGYSGAFIDYWANKECFNPCFYVELIRGRPKESSVLWTSNSIVALCGSRERLGSWSWHDGAEIIYFK

SEQ ID NO: 24440 - protein, 469 aa, Artificial Sequence
  neuraminidase__InfluenzaA__AHJ57992
MNPNQKIITIGSVSLTIATVSFLMQIAILTTTVTLHFKHNECNMPPKNQVMSCEPIIIERNITEIVYLNNTTVEKEICPKVVEYRNWSKPQCKITGFAPFSKDNSIRLSAGGDIWVTREPYVSCGLGKCYQFALGQGTTLDNSHSNGTIHDRIPHRTLLMNELGVPFHLGTKQVCIAWSSSSCHDGRAWLHICITGDDRNATASFIYDGMLVDSIGSWSKNILRTQESECVCINGTCAVVMTDGSASGVADTRILFIREGKIVHISPLSGSAQHIEECSCYPRYPDVRCVCRDNWKGSNRPVININMADYSIDSNYVCSGLVGDTPRNDDNSSSSNCRDPNNERGNPGVKGWAFDDGNDVWMGRTINRDSRSGYETFRVIGGWTTANSKSQINRQVIVDNNNWSGYSGVFSVEGKSCINRCFYVELIRGRPQEPRVWWTSNSIVVFCGTSGTYGTGSWPDGANINFMPI

SEQ ID NO: 24441 - protein, 470 aa, Artificial Sequence
  neuraminidase__InfluenzaA__AHJ58004
MNPNQKITCISATGVTLSVVSLLIGIANLGLNIGLHYKVSDSSNINIPNMNETNPTTTIINNHTQNNFKNITNIIVNKNEEGTFLNLTKPLCEVNSWHILSKDNAIRIGEDAHILVTREPYLSCDPQGCRMFALSQGTTLRGRHANGTIHDRSPFRALISWEMGQAPSPYNARVECIGWSSTSCHDGISRMSICISGPNNNASAVVWYRGRPVTEIPSWAGNILRTQESECVCHKGICPVVMTDGPANNRAATKIIYFKEGKIQKIEELKGNAQHIEECSCYGAAGMIKCICRDNWRGANRPVITIDPEMMTHTSKYLCSKILTDTSRPNDPTNGNCDEPITGGSPDPGVKGFAFLDGENSWLGRTISKDSRSGYEMLKVPNAETDTQSGPTSYQIIVNNQNWSGYSGAFIDYWANKECFNPCFYVELIRGRPKESSVLWTSNSIVALCGSRERLGSWSWHDGAEIIYFK

SEQ ID NO: 24442 - protein, 470 aa, Artificial Sequence
  neuraminidase__InfluenzaA__AHJ58016
MNPNQKITCISATGMTLSVVSMLIGIANLGLNIGLHYKVSDSTNINIPKMNETNPTTTIINNHPQNNFTNITNIIVNKNEEENFLNLTKPLCEVNSWHILSKDNAIRIGENAHILVTREPYLSCDPQGCRMFALSQGTTLRGRHANGTIHDRSPFRALISWEMGQAPSPYNARVECIGWSSTSCHDGISRMSICISGPNNNASAVVWYGGRPVTEIPSWAGNILRTQESECVCHGGICPVVMTDGPANNRAETKIIYFKEGKIQKIEELKGNAQHIEECSCYGASGMIKCICRDNWKGANRPVITIDPEMMTHTSKYLCSKILTDTSRPNDPTNGNCDAPITGGSPDPGVKGFAFLDGKNSWLGRTISKDSRSGYEMLKVPNAETDTQSGAISHQIIVNNQNWSGYSGAFIDYWANKECFNPCFYVELIRGRPKESSVLWTSNSIVALCGSRERLGSWSWHDGAEIIYLK

SEQ ID NO: 24443 - protein, 470 aa, Artificial Sequence
  neuraminidase__InfluenzaA__AHJ58028
MNPNQKITCISATGMTLSVVSMLIGIANLGLNIGLHYKVSDSTNINIPKMNETNPTTTIINNHPQNNFTNITNIIVNKNEEENFLNLTKPLCEVNSWHILSKDNAVRIGEDAHILVTREPYLSCDPQGCRMFALSQGTTLRGRHANGTIHDRSPFRALISWEMGQAPSPYNTRVECIGWSSTSCHDGISRMSICISGPNNNASAVVWYRGRPVTEIPSWAGNILRTQESECVCHKGICPVVMTDGPANNRAETKIIYFKEGKIQKIEELEGNAQHIEECSCYGTAGMIKCICRDNWRGANRPVITIDPEMMTHTSRYLCSKILTDTSRPNDPTNGNCDAPITGGSPDPGVKGFAFLDGKNSWLGRTISKDSRSGYEMLKVPNAETDIQSGPTSNQIIVNNQNWSGYSGAFIDYWANKECFNPCFYVELIRGRPKESNVLWTSNSIVALCGSRERLGSWSWHDGAEIIYFK

SEQ ID NO: 24444 - protein, 469 aa, Artificial Sequence
  neuraminidase__InfluenzaA__AHJ58040
MNPNQKIITVGSVSLAIATICLLMQIAILATTVTLHFKQNECNIPSKNQVMPCEPIIIERNITEVVYLNNTIIEKEICPKVVEYRNWSKPQCQITGFAPFSKDNSIRLSAGGDIWVTREPYVSCSPSKCYQFALGQGTTLDNSHSNGTIHDRIPHRTLLMNELGVPFHLGTKQVCIAWSSSSCHDGRAWLHVCITGDDRNATASFIYNGMLVDSISSWSRNILRTQESECVCINGTCTVIMTDGSASGVADTRILFIREGKIVHVSPLSGSAQHIEECSCYPRYPDVRCVCRDNWKGSNRPVVDINMADYSIDSHYVCSGLVGDTPRNDDSSSSSNCKDPNNERGNPGVKGWAFDDGNDVWMGRTISRDSRSGYETFRVIGGWTTANSKSQINRQVIVDNNNWSGYSGVFSVEGKSCINRCFYVELIRGRPQETRVWWTSNSIVVFCGTSGTYGTGSWPDGANINFMPI

SEQ ID NO: 24445 - protein, 469 aa, Artificial Sequence
  neuraminidase__InfluenzaA__AHJ58052
MNPNQKIITIGSVSLTIATVSFLMQIAILTTTVTLHFKHNECNMPPKNQVMSCEPIIIERNITEIVYLNNTTVEKEICPKVVEYRNWSKPQCKITGFAPFSKDNSIRLSAGGDIWVTREPYVSCGLGKCYQFALGQGTTLDNSHSNGTIHDRIPHRTLLMNELGVPFHLGTKQVCIAWSSSSCHDGRAWLHICITGDDRNATASFIYDGMLVDSIGSWSKNILRTQESECVCINGTCAVVMTDGSASGVADTRILFIREGKIVHISPLSGSAQHIEECSCYPRYPDVRCVCRDNWKGSNRPVIDINMADYSIDSNYVCSGLVGDTPRNDDNSSSSNCRDPNNERGNPGVKGWAFDDGNDVWMGRTINRDSRSGYETFRVIGGWTTANSKSQINRQVIVDNNNWSGYSGVFSVEGKSCINRCFYVELIRGRPQEPRVWWTSNSIVVFCGTSGTYGTGSWPDGANINFMPI

SEQ ID NO: 24446 - protein, 470 aa, Artificial Sequence
  neuraminidase__InfluenzaA__AHJ58064
MNPNQKITCISATGMTLSVVSLLIGIANLGLNIGLHYKVSDSTNINIPNMNETSPTTTIINNHPQNNFTNITNIIVNKNEEENFLNLTKPLCEVNSWHILSKDNAIRIGENAHILVTREPYLSCDPQGCRMFALSQGTTLRGQHANGTIHDRSPFRALISWEMGQAPSPYNARVECIGWSSTSCHDGISRMSICISGPNNNASAVVWYGGRPVTEIPSWAGNILRTQESECVCHGGICPVVMTDGPANNRAETKIIYFKEGKIQKIEELKGNAQHIEECSCYGASGMIKCICRDNWKGANRPVITIDPEMMTHTSKYLCSKILTDTSRPNDPINGNCDAPITGGSPDPGVKGFAFLDGENSWLGRTISKDSRSGYEMLKVPNAETDTQSGAISHQMIVNNQNWSGYSGAFIDYWANKECFNPCFYVELIRGRPKESSVLWTSNSIVALCGSRERLGSWSWHDGAEIIYFK

SEQ ID NO: 24447 - protein, 466 aa, Artificial Sequence
  neuraminidase__InfluenzaA__AHJ58075
MNPNQKIIAIGSVSLTIAIICFLLQIAILTTTMTLHFRQNECSNPSNNQVVPCEPIIIERNTVHLNSTTIEKEICPKVAEYKNWSKPQCQITGFAPFSKDNSIRLSAGGDIWVTREPYVSCSLGKCYQFALGQGTTLKNKHSNGTTHDRIPHRTLLMNELGVPFHLGTKQVCIAWSSSSCHDGKAWLHICVTGDDKNATASIIYDGMLVDSIGSWSKNILRTQESECVCINGTCAVVMTDGSASGKADTRILFIREGKIINISPLSGSAQHVEECSCYPRYPEVRCVCRDNWKGSNRPVLYINMADYSIESSYVCSGLVGDTPRDDDSSSSSNCRDPNNERGAPGVKGWAFDDGNDIWMGRTIKSDSRSGYETFRVVNGWTTANSKSQINRQVIVDSDSWSGYSGIFSVEGKNCINRCFYVELIRGRPQETRVWWTSNSIIVFCGTSGTYGTGSWPDGANINFMPI

SEQ ID NO: 24448 - protein, 470 aa, Artificial Sequence
  neuraminidase__InfluenzaA__AHJ58087
MNPNQKITCISATGMTLSVVSLLIGIANLGLNIGLHYKVSDSTNINIPNMNETSPTTTIINNHPQNNFTNITNIIVNKNEEENFLNLTKPLCEVNSWHILSKDNAIRIGENAHILVTREPYLSCDPQGCRMFALSQGTTLRGQHANGTIHDRSPFRALISWEMGQAPSPYNARVECIGWSSTSCHDGISRMSICISGPNNNASAVVWYGGRPVTEIPSWAGNILRTQESECVCHGGICPVVMTDGPANNRAETKIIYFKEGKIQKIEELKGNAQHIEECSCYGASGMIKCICRDNWKGANRPVITIDPEMMTHTSKYLCSKILTDTSRPNDPINGNCDAPITGGSPDPGVKGFAFLDGDNSWLGRTISKDSRSGYEMLKVPNAETDTQSGAISHQMIVNNQNWSGYSGAFIDYWANKECFNPCFYVELIRGRPKESSVLWTSNSIVALCGSRERLGSWSWHDGAEIIYFK

SEQ ID NO: 24449 - protein, 469 aa, Artificial Sequence
  neuraminidase__InfluenzaA__AHL80721
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDVVGINEWSGYSGSFVQHPELTGLDCIRPCFWVELIRGRPKENTIWTSGSSISFCGVNSDTVGWSWPDGAELPFTIDK

SEQ ID NO: 24450 - protein, 469 aa, Artificial Sequence
  neuraminidase__InfluenzaA__AHL80732
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYYYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFIIDK

SEQ ID NO: 24451 - protein, 469 aa, Artificial Sequence; identical to SEQ ID NO: 16738
  neuraminidase__InfluenzaA__AHL80743

SEQ ID NO: 24452 - protein, 469 aa, Artificial Sequence
  neuraminidase__InfluenzaA__AHL80754
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECVCVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 24453 - protein, 469 aa, Artificial Sequence; identical to SEQ ID NO: 16738
  neuraminidase__InfluenzaA__AHL80765

SEQ ID NO: 24454 - protein, 469 aa, Artificial Sequence; identical to SEQ ID NO: 16738
  neuraminidase__InfluenzaA__AHL80776

SEQ ID NO: 24455 - protein, 469 aa, Artificial Sequence; identical to SEQ ID NO: 16738
  neuraminidase__InfluenzaA__AHL80787

SEQ ID NO: 24456 - protein, 469 aa, Artificial Sequence
  neuraminidase__InfluenzaA__AHL80798
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKKGSCGPVSSNGANGVKGFSFKYGNGVWIGRTKSISSRNGFEMIWDPNGWTGTDNNFSVKQDIVGINEWSGYSGSFVQHPELTGLDCIRPCFWVELIRGRPKENTIWTSGSSISFCGVNSDTVGWSWPDGAELPFTIDK

SEQ ID NO: 24457 - protein, 469 aa, Artificial Sequence; identical to SEQ ID NO: 16738
  neuraminidase__InfluenzaA__AHL80809

SEQ ID NO: 24458 - protein, 469 aa, Artificial Sequence; identical to SEQ ID NO: 16738
  neuraminidase__InfluenzaA__AHL80820

SEQ ID NO: 24459 - protein, 469 aa, Artificial Sequence; identical to SEQ ID NO: 16738
  neuraminidase__InfluenzaA__AHL80831

SEQ ID NO: 24460 - protein, 469 aa, Artificial Sequence; identical to SEQ ID NO: 16738
  neuraminidase__InfluenzaA__AHL80842

SEQ ID NO: 24461 - protein, 469 aa, Artificial Sequence; identical to SEQ ID NO: 18026
  neuraminidase__InfluenzaA__AHL80853

SEQ ID NO: 24462 - protein, 469 aa, Artificial Sequence
  neuraminidase__InfluenzaA__AHL80864
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYYYEECSCYPDSSEITCVCRDNWHGSNRPWVSFNQNLEYQIGYICSGIFGDNPRPNDKKGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 24463 - protein, 469 aa, Artificial Sequence; identical to SEQ ID NO: 18026
  neuraminidase__InfluenzaA__AHL80875

SEQ ID NO: 24464 - protein, 469 aa, Artificial Sequence; identical to SEQ ID NO: 18026
  neuraminidase__InfluenzaA__AHL80886

SEQ ID NO: 24465 - protein, 469 aa, Artificial Sequence
  neuraminidase__InfluenzaA__AHL80897
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACINGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKKGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 24466 - protein, 469 aa, Artificial Sequence
  neuraminidase__InfluenzaA__AHL80908
MNPNQKIITIGSVCMTIGMANLILQIGNIISIWISHSIQLGNQNQIETCNQSVTIHENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYYYEECSCYPDSSEITCVCRDNWHGSNRPWVSFNQNLEYQIGYICSGIFGDNPRPNDKKGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 24467 - protein, 469 aa, Artificial Sequence
  neuraminidase__InfluenzaA__AHL80919
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPTGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 24468 - protein, 469 aa, Artificial Sequence; identical to SEQ ID NO: 19518
  neuraminidase__InfluenzaA__AHL80930

SEQ ID NO: 24469 - protein, 469 aa, Artificial Sequence; identical to SEQ ID NO: 19518
  neuraminidase__InfluenzaA__AHL80949

SEQ ID NO: 24470 - protein, 469 aa, Artificial Sequence
  neuraminidase__InfluenzaA__AHL80961
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDVVGINEWSGYSGSFVQHPELTGLDCIRPCFWVELIRGRPKENTIWTSGSSISFCGVNSDTVGWSWPDGAELPFTIDK

SEQ ID NO: 24471 - protein, 469 aa, Artificial Sequence; identical to SEQ ID NO: 24470
  neuraminidase__InfluenzaA__AHL80972

SEQ ID NO: 24472 - protein, 469 aa, Artificial Sequence; identical to SEQ ID NO: 19518
  neuraminidase__InfluenzaA__AHL80983

SEQ ID NO: 24473 - protein, 469 aa, Artificial Sequence; identical to SEQ ID NO: 19518
  neuraminidase__InfluenzaA__AHL80992

SEQ ID NO: 24474 - protein, 469 aa, Artificial Sequence; identical to SEQ ID NO: 19518
  neuraminidase__InfluenzaA__AHL81004

SEQ ID NO: 24475 - protein, 469 aa, Artificial Sequence
  neuraminidase__InfluenzaA__AHL81016
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDSDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24476 - protein, 469 aa, Artificial Sequence; identical to SEQ ID NO: 19518
  neuraminidase__InfluenzaA__AHL81028

SEQ ID NO: 24477 - protein, 469 aa, Artificial Sequence; identical to SEQ ID NO: 19518
  neuraminidase__InfluenzaA__AHL81040

SEQ ID NO: 24478 - protein, 469 aa, Artificial Sequence; identical to SEQ ID NO: 19518
  neuraminidase__InfluenzaA__AHL81052

SEQ ID NO: 24479 - protein, 469 aa, Artificial Sequence; identical to SEQ ID NO: 24470
  neuraminidase__InfluenzaA__AHL81064

SEQ ID NO: 24480 - protein, 469 aa, Artificial Sequence; identical to SEQ ID NO: 24470
  neuraminidase__InfluenzaA__AHL81075

SEQ ID NO: 24481 - protein, 469 aa, Artificial Sequence
  neuraminidase__InfluenzaA__AHL81086
MNPNQKIITIGSVSLTISTICFFMQIAILITTVTLHFKQYEFNSPPNNQVMLCKPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24482 - protein, 469 aa, Artificial Sequence
  neuraminidase__InfluenzaA__AHL81098
MNPNQKIITIGSVSLTISTICFFVQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24483 - protein, 469 aa, Artificial Sequence; identical to SEQ ID NO: 20709
  neuraminidase__InfluenzaA__AHL81110

SEQ ID NO: 24484 - protein, 469 aa, Artificial Sequence; identical to SEQ ID NO: 20709
  neuraminidase__InfluenzaA__AHL81121

SEQ ID NO: 24485 - protein, 469 aa, Artificial Sequence; identical to SEQ ID NO: 19518
  neuraminidase__InfluenzaA__AHL81132

SEQ ID NO: 24486 - protein, 469 aa, Artificial Sequence; identical to SEQ ID NO: 19518
  neuraminidase__InfluenzaA__AHL81144

SEQ ID NO: 24487 - protein, 469 aa, Artificial Sequence; identical to SEQ ID NO: 19518
  neuraminidase__InfluenzaA__AHL81156

SEQ ID NO: 24488 - protein, 469 aa, Artificial Sequence; identical to SEQ ID NO: 21787
  neuraminidase__InfluenzaA__AHL81168

SEQ ID NO: 24489 - protein, 469 aa, Artificial Sequence; identical to SEQ ID NO: 21787
  neuraminidase__InfluenzaA__AHL81180

SEQ ID NO: 24490 - protein, 469 aa, Artificial Sequence; identical to SEQ ID NO: 19518
  neuraminidase__InfluenzaA__AHL81192

SEQ ID NO: 24491 - protein, 469 aa, Artificial Sequence
  neuraminidase__InfluenzaA__AHL81215
MNPNQKIITIGSVSLTISTICFFMQIAILITTVTLHFKQYEFNSPPNNQVMLCEPTIIERNITEIMYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNFMPI

SEQ ID NO: 24492 - protein, 469 aa, Artificial Sequence
  neuraminidase__InfluenzaA__AHL81227
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPTGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIIGINEWSGYSGSFVQHPELTGLDCIRPCFWVELIRGRPKENTIWTSGSSISFCGVNSDTVGWSWPDGAELPFTIDK

SEQ ID NO: 24493 - protein, 469 aa, Artificial Sequence; identical to SEQ ID NO: 19518
  neuraminidase__InfluenzaA__AHL81238

SEQ ID NO: 24494 - protein, 469 aa, Artificial Sequence; identical to SEQ ID NO: 19518
  neuraminidase__InfluenzaA__AHL81250

SEQ ID NO: 24495 - protein, 469 aa, Artificial Sequence; identical to SEQ ID NO: 19518
  neuraminidase__InfluenzaA__AHL81262

SEQ ID NO: 24496 - protein, 469 aa, Artificial Sequence; identical to SEQ ID NO: 19518
  neuraminidase__InfluenzaA__AHL81274

SEQ ID NO: 24497 - protein, 469 aa, Artificial Sequence; identical to SEQ ID NO: 19518
  neuraminidase__InfluenzaA__AHL81286

SEQ ID NO: 24498 - protein, 469 aa, Artificial Sequence; identical to SEQ ID NO: 19518
  neuraminidase__InfluenzaA__AHL81298

SEQ ID NO: 24499 - protein, 469 aa, Artificial Sequence; identical to SEQ ID NO: 24470
  neuraminidase__InfluenzaA__AHL81310

SEQ ID NO: 24500 - protein, 469 aa, Artificial Sequence; identical to SEQ ID NO: 20709
  neuraminidase__InfluenzaA__AHL81332

SEQ ID NO: 24501 - protein, 469 aa, Artificial Sequence
  neuraminidase__InfluenzaA__AHL81343
MNPNQKIITIGSVSLTISTICFLMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVITDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCSDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 24502 - protein, 469 aa, Artificial Sequence; identical to SEQ ID NO: 19518
  neuraminidase__InfluenzaA__AHL81355

SEQ ID NO: 24503 - protein, 469 aa, Artificial Sequence; identical to SEQ ID NO: 20709
  neuraminidase__InfluenzaA__AHL81367

SEQ ID NO: 24504 - protein, 469 aa, Artificial Sequence; identical to SEQ ID NO: 20709
  neuraminidase__InfluenzaA__AHL81378

SEQ ID NO: 24505 - protein, 469 aa, Artificial Sequence; identical to SEQ ID NO: 20709
  neuraminidase__InfluenzaA__AHL81389

SEQ ID NO: 24506 - protein, 469 aa, Artificial Sequence; identical to SEQ ID NO: 19518
  neuraminidase__InfluenzaA__AHL81400

SEQ ID NO: 24507 - protein, 469 aa, Artificial Sequence; identical to SEQ ID NO: 24491
  neuraminidase__InfluenzaA__AHL81412

SEQ ID NO: 24508 - protein, 469 aa, Artificial Sequence; identical to SEQ ID NO: 16738
  neuraminidase__InfluenzaA__AHL81422

SEQ ID NO: 24509 - protein, 469 aa, Artificial Sequence; identical to SEQ ID NO: 18026
  neuraminidase__InfluenzaA__AHL81433

SEQ ID NO: 24510 - protein, 469 aa, Artificial Sequence
  neuraminidase__InfluenzaA__AHL88954
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIKEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRDNRSGYSGIFSVEGKSCINRCFYVELIRGRKEETEVLWTSNSIVVFCGTSGTYGTGSWPDGADINLMPI

SEQ ID NO: 24511 - protein, 469 aa, Artificial Sequence
  neuraminidase__InfluenzaA__AHL89033
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEDKSCINRCFYVELIRGRKEETEVLWTSNSIVVFCGTSGTYGTGSWPDGADINLMPI

SEQ ID NO: 24512 - protein, 469 aa, Artificial Sequence
  neuraminidase__InfluenzaA__AHL89045
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRHPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQTNRQVIVDRGNRSGYSGIFSVEGKSCINRCFYVELIRGRKEETEVLWTSNSIVVFCGTSGTYGTGSWPDGADINLMPI

SEQ ID NO: 24513 - protein, 469 aa, Artificial Sequence
  neuraminidase__InfluenzaA__AHL89057
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKEETEVLWTSNSIVVFCGTSGTYGTGSWPDGADINLMPI

SEQ ID NO: 24514 - protein, 469 aa, Artificial Sequence; identical to SEQ ID NO: 15707
  neuraminidase__InfluenzaA__AHL89069

SEQ ID NO: 24515 - protein, 469 aa, Artificial Sequence; identical to SEQ ID NO: 14712
  neuraminidase__InfluenzaA__AHL89081

SEQ ID NO: 24516 - protein, 469 aa, Artificial Sequence; identical to SEQ ID NO: 14712
  neuraminidase__InfluenzaA__AHL89093

SEQ ID NO: 24517 - protein, 469 aa, Artificial Sequence; identical to SEQ ID NO: 14712
  neuraminidase__InfluenzaA__AHL89117

SEQ ID NO: 24518 - protein, 469 aa, Artificial Sequence; identical to SEQ ID NO: 14712
  neuraminidase__InfluenzaA__AHL89129

SEQ ID NO: 24519 - protein, 469 aa, Artificial Sequence
  neuraminidase__InfluenzaA__AHL89141
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRLGYETFKVIEGWSNPNSKLQTNRQVIVDRGNRSGYSGIFSVEGKSCINRCFYVELIRGRKEETEVLWTSNSIVVFCGTSGTYGTGSWPDGADINLMPI

SEQ ID NO: 24520 - protein, 469 aa, Artificial Sequence
  neuraminidase__InfluenzaA__AHL89153
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFSLGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 24521 - protein, 469 aa, Artificial Sequence; identical to SEQ ID NO: 14712
  neuraminidase__InfluenzaA__AHL89165

SEQ ID NO: 24522 - protein, 469 aa, Artificial Sequence
  neuraminidase__InfluenzaA__AHL89177
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSNEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEENEVLWTSNSIVVFCGTSGTYGTGSWPDGADINLMPI

SEQ ID NO: 24523 - protein, 469 aa, Artificial Sequence; identical to SEQ ID NO: 16564
  neuraminidase__InfluenzaA__AHL89189

SEQ ID NO: 24524 - protein, 469 aa, Artificial Sequence; identical to SEQ ID NO: 15707
  neuraminidase__InfluenzaA__AHL89201

SEQ ID NO: 24525 - protein, 469 aa, Artificial Sequence; identical to SEQ ID NO: 16564
  neuraminidase__InfluenzaA__AHL89213

SEQ ID NO: 24526 - protein, 469 aa, Artificial Sequence
  neuraminidase__InfluenzaA__AHL89225
MNPNQKIITIGSVSLTISTICFFMQIAILITTVTLHFKQYEFNPPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRLGYETFKVIEGWSNPNSKLQTNRQVIVDRGNRSGYSGIFSVEGKSCINRCFYVELIRGRKEETEVLWTSNSIVVFCGTSGTYGTGSWPDGADINLMPI

SEQ ID NO: 24527 - protein, 469 aa, Artificial Sequence; identical to SEQ ID NO: 16564
  neuraminidase__InfluenzaA__AHL89237

SEQ ID NO: 24528 - protein, 469 aa, Artificial Sequence; identical to SEQ ID NO: 15707
  neuraminidase__InfluenzaA__AHL89261

SEQ ID NO: 24529 - protein, 469 aa, Artificial Sequence
  neuraminidase__InfluenzaA__AHL89273
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRLGYETFKVIEGWSNPNSKLQTNRQVIVDRGNRSGYSGIFSVEGKSCINRCFYVELIRGRKEETDVLWTSNSIVVFCGTSGTYGTGSWPDGADINLMPI

SEQ ID NO: 24530 - protein, 469 aa, Artificial Sequence
  neuraminidase__InfluenzaA__AHL89285
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRLGYETFKVIEGWSNPNSKLQTNRQVIVDRGNRSGYSGIFSVEGKSCINRCFYVELIRGRKEETDVLWTSNSIVVFCSTSGTYGTGSWPDGADINLMPI

SEQ ID NO: 24531 - protein, 469 aa, Artificial Sequence; identical to SEQ ID NO: 24529
  neuraminidase__InfluenzaA__AHL89297

SEQ ID NO: 24532 - protein, 469 aa, Artificial Sequence; identical to SEQ ID NO: 24529
  neuraminidase__InfluenzaA__AHL89309

SEQ ID NO: 24533 - protein, 469 aa, Artificial Sequence
  neuraminidase__InfluenzaA__AHL89321
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSVVSWSKDILRTQESECVCINGTCTVVMTDGSASGKADTKILFIEEGKIVHISTLSGSAQHVEECSCYPRYPGVRCVCRDNWKGSNRPIVDINIKNYSIVSSYVCSGLVGDTPRKTDSSSSSHCLDPNNEEGGHGVKGWAFDDGNDVWMGRTISEKLRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 24534 - protein, 469 aa, Artificial Sequence
  neuraminidase__InfluenzaA__AHL89333
MNPNQKIITIGSVSLTISTICFFMQIAILIATVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCAVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRLGYETFKVIEGWSNPNSKLQTNRQVIVDRGNRSGYSGIFSVEGKSCINRCFYVELIRGRKEETEVLWTSNSIVVFCGTSGTYGTGSWPDGADINLMPI

SEQ ID NO: 24535 - protein, 469 aa, Artificial Sequence; identical to SEQ ID NO: 14712
  neuraminidase__InfluenzaA__AHL89345

SEQ ID NO: 24536 - protein, 469 aa, Artificial Sequence; identical to SEQ ID NO: 15706
  neuraminidase__InfluenzaA__AHL89357

SEQ ID NO: 24537 - protein, 469 aa, Artificial Sequence; identical to SEQ ID NO: 15707
  neuraminidase__InfluenzaA__AHL89369

SEQ ID NO: 24538 - protein, 469 aa, Artificial Sequence
  neuraminidase__InfluenzaA__AHL89381
MNPNQKIITIGSVSLTISTICFFMQIAILITTVTLHFKQYEYNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRLGYETFKVIEGWSNPNSKLQTNRQVIVDRGNRSGYSGIFSVEGKSCINRCFYVELIRGRKEETEVLWTSNSIVVFCGTSGTYGTGSWPDGADINLMPI

SEQ ID NO: 24539 - protein, 469 aa, Artificial Sequence; identical to SEQ ID NO: 24529
  neuraminidase__InfluenzaA__AHL89405

SEQ ID NO: 24540 - protein, 469 aa, Artificial Sequence
  neuraminidase__InfluenzaA__AHL89417
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDIDIKNYSIVSSYVCSGLVGDTPRKTDSSSSSHCLDPNNEEGGHGVKGWAFDDGNDVWMGRTISEKLRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 24541 - protein, 469 aa, Artificial Sequence; identical to SEQ ID NO: 15707
  neuraminidase__InfluenzaA__AHL89429

SEQ ID NO: 24542 - protein, 469 aa, Artificial Sequence; identical to SEQ ID NO: 14712
  neuraminidase__InfluenzaA__AHL89441

SEQ ID NO: 24543 - protein, 469 aa, Artificial Sequence; identical to SEQ ID NO: 14712
  neuraminidase__InfluenzaA__AHL89453

SEQ ID NO: 24544 - protein, 469 aa, Artificial Sequence
  neuraminidase__InfluenzaA__AHL89465
MNPNQKIITIGSVSLTISTICFFMQIAILITTVTLHFKQYEFNSPPNNQVMLCEPTIIERNITEIVYLTNITIEKEKCPKLAEYRNWSKPQCNITGFAPFSKDNSIRLSAGGDIWVTREPYVSCDPDRCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRLGYETFKVIEGWSNPNSKLQTNRQVIVDRGNRSGYSGIFSVEGKSCINRCFYVELIRGRKEETEVLWTSNSIVVFCGTSGTYGTGSWPDGADINLMPI

SEQ ID NO: 24545 - protein, 469 aa, Artificial Sequence; identical to SEQ ID NO: 24519
  neuraminidase__InfluenzaA__AHL89477

SEQ ID NO: 24546 - protein, 469 aa, Artificial Sequence
  neuraminidase__InfluenzaA__AHL89489
MNPNQKIITIGSVSLTISTICFFMQIAILITTVTLHFKQYEFNSPPNNQVMLCEPTIIERNITEIVYLTNTTIEKEICPKLAEYRNWSKPQCSITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDRSSSSHCLDPNNEEGGHGVKGWAFDDGNDVWMGRTISEKSRSGYETFKVIEGWSNPHSKLQINRQVIVDRGNRSGYSGIFSVEGKSCINRCFYVELIRGRKEETEVLWTSNSIVVFCGTSGTYGTGSWPDGADINLMPI

SEQ ID NO: 24547 - protein, 469 aa, Artificial Sequence; identical to SEQ ID NO: 15707
  neuraminidase__InfluenzaA__AHL89501

SEQ ID NO: 24548 - protein, 469 aa, Artificial Sequence; identical to SEQ ID NO: 15707
  neuraminidase__InfluenzaA__AHL89513

SEQ ID NO: 24549 - protein, 469 aa, Artificial Sequence; identical to SEQ ID NO: 15707
  neuraminidase__InfluenzaA__AHL89525

SEQ ID NO: 24550 - protein, 469 aa, Artificial Sequence; identical to SEQ ID NO: 15707
  neuraminidase__InfluenzaA__AHL89537

SEQ ID NO: 24551 - protein, 470 aa, Artificial Sequence
  neuraminidase__InfluenzaA__AHL89549
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQHLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 24552 - protein, 470 aa, Artificial Sequence; identical to SEQ ID NO: 16030
  neuraminidase__InfluenzaA__AHL89561

SEQ ID NO: 24553 - protein, 470 aa, Artificial Sequence; identical to SEQ ID NO: 16030
  neuraminidase__InfluenzaA__AHL89573

SEQ ID NO: 24554 - protein, 470 aa, Artificial Sequence; identical to SEQ ID NO: 16065
  neuraminidase__InfluenzaA__AHL89585

SEQ ID NO: 24555 - protein, 470 aa, Artificial Sequence
  neuraminidase__InfluenzaA__AHL89597
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVRDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQVGYICSGVFGDNPRPKDGKGSCNPMTVDGADGVKGFSYKYGNGVWIGRTKSNKLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 24556 - protein, 470 aa, Artificial Sequence; identical to SEQ ID NO: 16065
  neuraminidase__InfluenzaA__AHL89609

SEQ ID NO: 24557 - protein, 470 aa, Artificial Sequence
  neuraminidase__InfluenzaA__AHL89621
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRHRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 24558 - protein, 470 aa, Artificial Sequence; identical to SEQ ID NO: 16056
  neuraminidase__InfluenzaA__AHL89633

SEQ ID NO: 24559 - protein, 470 aa, Artificial Sequence; identical to SEQ ID NO: 16065
  neuraminidase__InfluenzaA__AHL89645

SEQ ID NO: 24560 - protein, 470 aa, Artificial Sequence; identical to SEQ ID NO: 16030
  neuraminidase__InfluenzaA__AHL89657

SEQ ID NO: 24561 - protein, 470 aa, Artificial Sequence
  neuraminidase__InfluenzaA__AHL89669
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQVGYICSGVFGDNPRPKDGKGSCNPMTVDGADGVKGFSYKYGNGVWIGRTKSNELRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 24562 - protein, 470 aa, Artificial Sequence
  neuraminidase__InfluenzaA__AHL89681
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKITKSIELNAPNFHYEECSCYPDTGTVMCVCRDNWHGSNRPWVSFNQNLDYQVGYICSGVFGDNPRPKDGKGSCNPMTVDGADGVKGFSYKYGNGVWIGRTKSNKLRKGFEMIWDPNGWTDTDSDFSVKQDVVAITDWSGYSGSFVQHPELTGLDCIRPCFWVELVRGLPRENATIWTSGSSISFCGVDSDTANWSWPDGAELPFTIDK

SEQ ID NO: 24563 - protein, 470 aa, Artificial Sequence
  neuraminidase__InfluenzaA__AHL89693
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYKGIITGTIKSWRKQILRTQESECVCMNGSCFTIMTDGPSNGAASYKIFKIEKGKVTKSIELNAPNFHYEECSCYPDTGIVMCVCRDNWHGSNRPWVSFNQNLDYQIGYICSGVFGDNPRPKDGEGSCNPVTVDGADGVKGFSYKYDDGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 24564 - protein, 470 aa, Artificial Sequence
  neuraminidase__InfluenzaA__AHL89705
MNPNQKIITIGSISIAIGIISLMLQIGNIISIWASHSIQNGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 24565 - protein, 470 aa, Artificial Sequence; identical to SEQ ID NO: 16030
  neuraminidase__InfluenzaA__AHL89717

SEQ ID NO: 24566 - protein, 470 aa, Artificial Sequence; identical to SEQ ID NO: 16030
  neuraminidase__InfluenzaA__AHL89729

SEQ ID NO: 24567 - protein, 470 aa, Artificial Sequence
  neuraminidase__InfluenzaA__AHL89753
MNPNQKIITIGSISIAIGIISLMLQIGNIISIWASHSIQTGSQNHTGICNQRIITYENSTWVNHTYVSINNTNVVAGNDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 24568 - protein, 470 aa, Artificial Sequence; identical to SEQ ID NO: 16030
  neuraminidase__InfluenzaA__AHL89765

SEQ ID NO: 24569 - protein, 470 aa, Artificial Sequence; identical to SEQ ID NO: 16071
  neuraminidase__InfluenzaA__AHL89777

SEQ ID NO: 24570 - protein, 470 aa, Artificial Sequence; identical to SEQ ID NO: 16030
  neuraminidase__InfluenzaA__AHL89789

SEQ ID NO: 24571 - protein, 470 aa, Artificial Sequence
  neuraminidase__InfluenzaA__AHL89801
MNPNQKIITIGSISIAIGIISLMLQIGNIISIWASHSIQTGSQNHTGICNQRIITYENSTWVNHTYVNINNTNVVAGKDKTSVALAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 24572 - protein, 470 aa, Artificial Sequence
  neuraminidase__InfluenzaA__AHL89813
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQVGYICSGVFGDNPRPKDGKGSCNPMTADGADGVKGFSYKYGNGVWIGRTKSNKLRKGFEMIWDPNGWTDTDSDFSVKQDVVAITDWSGYSGSFVQHPELTGLDCIRPCFWVELVRGLPRENATIWTSGSSISFCGVDSDTANWSWPDGAELPFTIDK

SEQ ID NO: 24573 - protein, 470 aa, Artificial Sequence; identical to SEQ ID NO: 16071
  neuraminidase__InfluenzaA__AHL89825

SEQ ID NO: 24574 - protein, 470 aa, Artificial Sequence; identical to SEQ ID NO: 16030
  neuraminidase__InfluenzaA__AHL89837

SEQ ID NO: 24575 - protein, 470 aa, Artificial Sequence
  neuraminidase__InfluenzaA__AHL89849
MNPNQKIITIGSISIAIGIISLMLQIGNIISIWASHSIQTGSQNHTGICNQRIITYENSTWVNHTYVYINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGMVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 24576 - protein, 469 aa, Artificial Sequence; identical to SEQ ID NO: 16066
  neuraminidase__InfluenzaA__AHL89861

SEQ ID NO: 24577 - protein, 469 aa, Artificial Sequence
  neuraminidase__InfluenzaA__AHL89873
MNPNQKIITIGSVSLTISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDGGNRSGYSGIFSVEGKSCINRCFYVELIRGRKEETEVLWTSNSIVVFCGTSGTYGTGSWPDGADINLMPI

SEQ ID NO: 24578 - protein, 469 aa, Artificial Sequence; identical to SEQ ID NO: 16743
  neuraminidase__InfluenzaA__AHL89885

SEQ ID NO: 24579 - protein, 469 aa, Artificial Sequence
  neuraminidase__InfluenzaA__AHL89897
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQTNRQVIVDRGNRSGYSGIFSVEGKSCINRCFYVELIRGRKEETEVLWTSNSIVVFCGTSGTYGTGSWPDGADINLMPI

SEQ ID NO: 24580 - protein, 469 aa, Artificial Sequence; identical to SEQ ID NO: 16402
  neuraminidase__InfluenzaA__AHL89909

SEQ ID NO: 24581 - protein, 469 aa, Artificial Sequence; identical to SEQ ID NO: 16041
  neuraminidase__InfluenzaA__AHL89921

SEQ ID NO: 24582 - protein, 469 aa, Artificial Sequence; identical to SEQ ID NO: 16402
  neuraminidase__InfluenzaA__AHL89933

SEQ ID NO: 24583 - protein, 469 aa, Artificial Sequence; identical to SEQ ID NO: 16041
  neuraminidase__InfluenzaA__AHL89945

SEQ ID NO: 24584 - protein, 469 aa, Artificial Sequence
  neuraminidase__InfluenzaA__AHL89957
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIKEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 24585 - protein, 469 aa, Artificial Sequence; identical to SEQ ID NO: 15884
  neuraminidase__InfluenzaA__AHL89969

SEQ ID NO: 24586 - protein, 469 aa, Artificial Sequence; identical to SEQ ID NO: 15884
  neuraminidase__InfluenzaA__AHL89981

SEQ ID NO: 24587 - protein, 469 aa, Artificial Sequence
  neuraminidase__InfluenzaA__AHL89993
MNPNQKIITIGSVSLSISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTLVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 24588 - protein, 469 aa, Artificial Sequence
  neuraminidase__InfluenzaA__AHL90005
MNPNQKIITIGSVSLTISTICFFMQIAILITTVTLHFKQYEFSSPPNNQVMLCEPTIIKRNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKNDSYSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 24589 - protein, 469 aa, Artificial Sequence; identical to SEQ ID NO: 16090
  neuraminidase__InfluenzaA__AHL90017

SEQ ID NO: 24590 - protein, 469 aa, Artificial Sequence; identical to SEQ ID NO: 16041
  neuraminidase__InfluenzaA__AHL90029

SEQ ID NO: 24591 - protein, 469 aa, Artificial Sequence; identical to SEQ ID NO: 16057
  neuraminidase__InfluenzaA__AHL90041

SEQ ID NO: 24592 - protein, 469 aa, Artificial Sequence; identical to SEQ ID NO: 16057
  neuraminidase__InfluenzaA__AHL90053

SEQ ID NO: 24593 - protein, 469 aa, Artificial Sequence; identical to SEQ ID NO: 22322
  neuraminidase__InfluenzaA__AHL90065

SEQ ID NO: 24594 - protein, 469 aa, Artificial Sequence; identical to SEQ ID NO: 24584
  neuraminidase__InfluenzaA__AHL90077

SEQ ID NO: 24595 - protein, 469 aa, Artificial Sequence; identical to SEQ ID NO: 16066
  neuraminidase__InfluenzaA__AHL90089

SEQ ID NO: 24596 - protein, 469 aa, Artificial Sequence; identical to SEQ ID NO: 16743
  neuraminidase__InfluenzaA__AHL90101

SEQ ID NO: 24597 - protein, 469 aa, Artificial Sequence; identical to SEQ ID NO: 16041
  neuraminidase__InfluenzaA__AHL90113

SEQ ID NO: 24598 - protein, 470 aa, Artificial Sequence; identical to SEQ ID NO: 16632
  neuraminidase__InfluenzaA__AHL90125

SEQ ID NO: 24599 - protein, 470 aa, Artificial Sequence
  neuraminidase__InfluenzaA__AHL90136
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDSGMVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 24600 - protein, 470 aa, Artificial Sequence; identical to SEQ ID NO: 16632
  neuraminidase__InfluenzaA__AHL90160

SEQ ID NO: 24601 - protein, 470 aa, Artificial Sequence
  neuraminidase__InfluenzaA__AHL90172
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGNCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 24602 - protein, 470 aa, Artificial Sequence; identical to SEQ ID NO: 16632
  neuraminidase__InfluenzaA__AHL90184

SEQ ID NO: 24603 - protein, 470 aa, Artificial Sequence; identical to SEQ ID NO: 19930
  neuraminidase__InfluenzaA__AHL90196

SEQ ID NO: 24604 - protein, 470 aa, Artificial Sequence; identical to SEQ ID NO: 16632
  neuraminidase__InfluenzaA__AHL90220

SEQ ID NO: 24605 - protein, 470 aa, Artificial Sequence
  neuraminidase__InfluenzaA__AHL90232
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVNGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 24606 - protein, 470 aa, Artificial Sequence
  neuraminidase__InfluenzaA__AHL90244
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPMTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTASWSWPDGAELPFTIDK

SEQ ID NO: 24607 - protein, 470 aa, Artificial Sequence; identical to SEQ ID NO: 17461
  neuraminidase__InfluenzaA__AHL90256

SEQ ID NO: 24608 - protein, 470 aa, Artificial Sequence
  neuraminidase__InfluenzaA__AHL90268
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTSIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDRDFSVKQDVVAITDWSGYSGSFVQHPELTGLDCIRPCFWVELVRGLPRENTTIWTSGSSISFCGVNSDTANWSWPDGAELPFTIDK

SEQ ID NO: 24609 - protein, 470 aa, Artificial Sequence; identical to SEQ ID NO: 17461
  neuraminidase__InfluenzaA__AHL90280

SEQ ID NO: 24610 - protein, 470 aa, Artificial Sequence
  neuraminidase__InfluenzaA__AHL90304
MNPNQKIITIGSISIAIGIISLMLQIGNIISIWASHSIQTGSQNNTEICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 24611 - protein, 470 aa, Artificial Sequence; identical to SEQ ID NO: 16632
  neuraminidase__InfluenzaA__AHL90316

SEQ ID NO: 24612 - protein, 470 aa, Artificial Sequence
  neuraminidase__InfluenzaA__AHL90328
MNPNKKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAVTDWSGYSGSFVQHPELTGLDCIRPCFWVELVRGLPRENTTIWTSGSSISFCGVNSDTANWSWPDGAELPFTIDK

SEQ ID NO: 24613 - protein, 470 aa, Artificial Sequence; identical to SEQ ID NO: 16632
  neuraminidase__InfluenzaA__AHL90340

SEQ ID NO: 24614 - protein, 470 aa, Artificial Sequence
  neuraminidase__InfluenzaA__AHL90352
MNPNQKIMTIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCSPVTVDGANGVKGFSYKYDNGVWIGRTKSNRLRKGFEMIWDPNGWTNTDSDFSVKQDVVAITDWSGYSGSFVQHPELTGLDCIRPCFWVELVRGMPRENTTIWTSGSSISFCGVNSDTANWSWPDGAELPFTIDK

SEQ ID NO: 24615 - protein, 470 aa, Artificial Sequence; identical to SEQ ID NO: 23461
  neuraminidase__InfluenzaA__AHL90364

SEQ ID NO: 24616 - protein, 470 aa, Artificial Sequence; identical to SEQ ID NO: 17461
  neuraminidase__InfluenzaA__AHL90376

SEQ ID NO: 24617 - protein, 469 aa, Artificial Sequence
  neuraminidase__InfluenzaA__AHL90388
MNPNQKIITIGSVSLIISTICFFMQIAILITTVTLHFKQYEFNSSPNNQVMLCEPTIIERNITEIVYLTNTIIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 24618 - protein, 469 aa, Artificial Sequence; identical to SEQ ID NO: 16512
  neuraminidase__InfluenzaA__AHL90400

SEQ ID NO: 24619 - protein, 469 aa, Artificial Sequence; identical to SEQ ID NO: 16512
  neuraminidase__InfluenzaA__AHL90413

SEQ ID NO: 24620 - protein, 469 aa, Artificial Sequence
  neuraminidase__InfluenzaA__AHL90425
MNPNQKIITIGSVSLTISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGDRSGYSGIFSVEGKSCINRCFYVELIRGRKEETEVLWTSNSIVVFCGTSGTYGTGSWPDGADINLMPI

SEQ ID NO: 24621 - protein, 469 aa, Artificial Sequence; identical to SEQ ID NO: 16599
  neuraminidase__InfluenzaA__AHL90437

SEQ ID NO: 24622 - protein, 469 aa, Artificial Sequence; identical to SEQ ID NO: 16512
  neuraminidase__InfluenzaA__AHL90449

SEQ ID NO: 24623 - protein, 469 aa, Artificial Sequence; identical to SEQ ID NO: 16512
  neuraminidase__InfluenzaA__AHL90461

SEQ ID NO: 24624 - protein, 469 aa, Artificial Sequence; identical to SEQ ID NO: 16512
  neuraminidase__InfluenzaA__AHL90473

SEQ ID NO: 24625 - protein, 469 aa, Artificial Sequence; identical to SEQ ID NO: 16512
  neuraminidase__InfluenzaA__AHL90485

SEQ ID NO: 24626 - protein, 469 aa, Artificial Sequence; identical to SEQ ID NO: 16603
  neuraminidase__InfluenzaA__AHL90497

SEQ ID NO: 24627 - protein, 469 aa, Artificial Sequence; identical to SEQ ID NO: 16603
  neuraminidase__InfluenzaA__AHL90509

SEQ ID NO: 24628 - protein, 469 aa, Artificial Sequence
  neuraminidase__InfluenzaA__AHL90521
MNPNQKIITIGSVSLTISTICFFLQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 24629 - protein, 469 aa, Artificial Sequence
  neuraminidase__InfluenzaA__AHL90533
MNPNQKIITIGSVSLTISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVERGDRSGYSGIFSVEGKSCINRCFYVELIRGRKEETEVLWTSNSIVVFCGTSGTYGTGSWPDGADINLMPI

SEQ ID NO: 24630 - protein, 469 aa, Artificial Sequence; identical to SEQ ID NO: 16512
  neuraminidase__InfluenzaA__AHL90545

SEQ ID NO: 24631 - protein, 469 aa, Artificial Sequence; identical to SEQ ID NO: 16599
  neuraminidase__InfluenzaA__AHL90557

SEQ ID NO: 24632 - protein, 469 aa, Artificial Sequence
  neuraminidase__InfluenzaA__AHL90569
MNPNQKIITIGSVSLTISTICFFMQIAILITTVTLHFKQYEFNSPPNNQVMLCEPTIIERNITEIVYLTNTTIEKEICPKLAEYRNWSKPQCDIKGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 24633 - protein, 469 aa, Artificial Sequence; identical to SEQ ID NO: 16599
  neuraminidase__InfluenzaA__AHL90581

SEQ ID NO: 24634 - protein, 469 aa, Artificial Sequence; identical to SEQ ID NO: 16603
  neuraminidase__InfluenzaA__AHL90593

SEQ ID NO: 24635 - protein, 469 aa, Artificial Sequence
  neuraminidase__InfluenzaA__AHL90605
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGANINLMPI

SEQ ID NO: 24636 - protein, 469 aa, Artificial Sequence; identical to SEQ ID NO: 16599
  neuraminidase__InfluenzaA__AHL90629

SEQ ID NO: 24637 - protein, 469 aa, Artificial Sequence; identical to SEQ ID NO: 16599
  neuraminidase__InfluenzaA__AHL90641

SEQ ID NO: 24638 - protein, 469 aa, Artificial Sequence; identical to SEQ ID NO: 16512
  neuraminidase__InfluenzaA__AHL90653

SEQ ID NO: 24639 - protein, 469 aa, Artificial Sequence; identical to SEQ ID NO: 16599
  neuraminidase__InfluenzaA__AHL90665

SEQ ID NO: 24640 - protein, 469 aa, Artificial Sequence
  neuraminidase__InfluenzaA__AHL90677
MNPNQKIITIGSVSLTISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 24641 - protein, 469 aa, Artificial Sequence; identical to SEQ ID NO: 16599
  neuraminidase__InfluenzaA__AHL90689

SEQ ID NO: 24642 - protein, 469 aa, Artificial Sequence
  neuraminidase__InfluenzaA__AHL90701
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGGIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 24643 - protein, 469 aa, Artificial Sequence; identical to SEQ ID NO: 19304
  neuraminidase__InfluenzaA__AHL90713

SEQ ID NO: 24644 - protein, 470 aa, Artificial Sequence; identical to SEQ ID NO: 19937
  neuraminidase__InfluenzaA__AHL90725

SEQ ID NO: 24645 - protein, 470 aa, Artificial Sequence; identical to SEQ ID NO: 18930
  neuraminidase__InfluenzaA__AHL90749

SEQ ID NO: 24646 - protein, 470 aa, Artificial Sequence; identical to SEQ ID NO: 17461
  neuraminidase__InfluenzaA__AHL90761

SEQ ID NO: 24647 - protein, 470 aa, Artificial Sequence
  neuraminidase__InfluenzaA__AHL90773
MNPNQKIITIGSISIAIGIISLMLQIGNIISIWASHSIQTGSQNNTGICNQRIITYENSTWVNHTYVNINNTNVVAGEDKTSMTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDREGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 24648 - protein, 470 aa, Artificial Sequence
  neuraminidase__InfluenzaA__AHL90785
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVNGADGVKGFSYKYGNGVWIGRTKSNRLRKGFEMIWDPNGWTNTDSDFSVKQDVVAITDWSGYSGSFVQHPELTGLDCIRPCFWVELVRGLPRENITIWTSGSSISFCGVNSDTANWSWPDGAELPFTIDK

SEQ ID NO: 24649 - protein, 470 aa, Artificial Sequence
  neuraminidase__InfluenzaA__AHL90797
MNPNQKIITIGSISIAIGIISLMLQIGNIISIWASHSIQTGSQNNTGICNKRIITYENSTWVNHTYVNINNTNVVAGEDKTSVTLAGNSSLCSISGWAIYTKDNSIRIGSKGDVFVIREPFIACSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSDKAASYKIFKIEKGKVTKSIELNAPNFHYEECSCYPDTGIVMCVCRDNWHGSNRPWVSFNQNLDYQIGYICSGVFGDNPRPEDGEGSCSPVTVDGANGVKGFSYKYDNGVWIGRTKSNRLRKGFEVIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 24650 - protein, 470 aa, Artificial Sequence; identical to SEQ ID NO: 17461
  neuraminidase__InfluenzaA__AHL90809

SEQ ID NO: 24651 - protein, 470 aa, Artificial Sequence; identical to SEQ ID NO: 19937
  neuraminidase__InfluenzaA__AHL90821

SEQ ID NO: 24652 - protein, 470 aa, Artificial Sequence
  neuraminidase__InfluenzaA__AHL90833
MNPNQRIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTAKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQMGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 24653 - protein, 470 aa, Artificial Sequence; identical to SEQ ID NO: 17461
  neuraminidase__InfluenzaA__AHL90845

SEQ ID NO: 24654 - protein, 470 aa, Artificial Sequence; identical to SEQ ID NO: 18930
  neuraminidase__InfluenzaA__AHL90857

SEQ ID NO: 24655 - protein, 470 aa, Artificial Sequence; identical to SEQ ID NO: 17461
  neuraminidase__InfluenzaA__AHL90869

SEQ ID NO: 24656 - protein, 470 aa, Artificial Sequence
  neuraminidase__InfluenzaA__AHL90881
MNPNQKIITIGSISIAIGIISTMLQIGSIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLIKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 24657 - protein, 470 aa, Artificial Sequence; identical to SEQ ID NO: 19937
  neuraminidase__InfluenzaA__AHL90893

SEQ ID NO: 24658 - protein, 470 aa, Artificial Sequence; identical to SEQ ID NO: 18930
  neuraminidase__InfluenzaA__AHL90905

SEQ ID NO: 24659 - protein, 470 aa, Artificial Sequence
  neuraminidase__InfluenzaA__AHL90917
MNPNQKIITIGSISIAIGIISLTLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 24660 - protein, 470 aa, Artificial Sequence
  neuraminidase__InfluenzaA__AHL90929
MNPNQKIITIGSISIAIGIISLMLQIGNIISIWASHSIQTGSQNNTGICNQRIITYENSTWVNHTYVNINNTNVVAGEDKTSMTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 24661 - protein, 470 aa, Artificial Sequence; identical to SEQ ID NO: 18930
  neuraminidase__InfluenzaA__AHL90941

SEQ ID NO: 24662 - protein, 470 aa, Artificial Sequence; identical to SEQ ID NO: 18930
  neuraminidase__InfluenzaA__AHL90953

SEQ ID NO: 24663 - protein, 470 aa, Artificial Sequence; identical to SEQ ID NO: 18930
  neuraminidase__InfluenzaA__AHL90965

SEQ ID NO: 24664 - protein, 470 aa, Artificial Sequence
  neuraminidase__InfluenzaA__AHL90977
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAIADWSGYSGSFVQHPELTGLDCIRPCFWVELVRGLPRENTTIWTSGSSISFCGVNSDTANWSWPDGAELPFTIDK

SEQ ID NO: 24665 - protein, 470 aa, Artificial Sequence; identical to SEQ ID NO: 20204
  neuraminidase__InfluenzaA__AHL90989

SEQ ID NO: 24666 - protein, 470 aa, Artificial Sequence; identical to SEQ ID NO: 24660
  neuraminidase__InfluenzaA__AHL91001

SEQ ID NO: 24667 - protein, 470 aa, Artificial Sequence
  neuraminidase__InfluenzaA__AHL91013
MNPNQKIITIGSISIAIGIISLMLQIGNIISIWASHSIQTGSQNNTGICSQRIITYENSTWVNHTYVNINNTNVVAGEDKTSMTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIRSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 24668 - protein, 470 aa, Artificial Sequence; identical to SEQ ID NO: 24660
  neuraminidase__InfluenzaA__AHL91025

SEQ ID NO: 24669 - protein, 469 aa, Artificial Sequence; identical to SEQ ID NO: 17905
  neuraminidase__InfluenzaA__AHL91037

SEQ ID NO: 24670 - protein, 469 aa, Artificial Sequence; identical to SEQ ID NO: 19518
  neuraminidase__InfluenzaA__AHL91049

SEQ ID NO: 24671 - protein, 469 aa, Artificial Sequence
  neuraminidase__InfluenzaA__AHL91061
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLNPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24672 - protein, 469 aa, Artificial Sequence
  neuraminidase__InfluenzaA__AHL91073
MNPNQKIITIGSVSLTISTICFFMQIAILITTVTLHFKQYEFNSPPNNQVMLCEPTIIERNITEIVYLTNTTIEKEICPKLAEYRTWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSGSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24673 - protein, 469 aa, Artificial Sequence
  neuraminidase__InfluenzaA__AHL91085
MNPNQKIITIGSVSLTISTICFFMQIAILITTVTLHFKQYEFNSPPNNQVMLCEPKIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGICTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 24674 - protein, 469 aa, Artificial Sequence; identical to SEQ ID NO: 16599
  neuraminidase__InfluenzaA__AHL91097

SEQ ID NO: 24675 - protein, 469 aa, Artificial Sequence
  neuraminidase__InfluenzaA__AHL91109
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADLNIMPI

SEQ ID NO: 24676 - protein, 469 aa, Artificial Sequence; identical to SEQ ID NO: 17905
  neuraminidase__InfluenzaA__AHL91121

SEQ ID NO: 24677 - protein, 469 aa, Artificial Sequence
  neuraminidase__InfluenzaA__AHL91133
MNPNQKIITIGSVSLTISTICFFMQIAILITTVTLHFKQFEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24678 - protein, 469 aa, Artificial Sequence; identical to SEQ ID NO: 19304
  neuraminidase__InfluenzaA__AHL91145

SEQ ID NO: 24679 - protein, 469 aa, Artificial Sequence; identical to SEQ ID NO: 19304
  neuraminidase__InfluenzaA__AHL91157

SEQ ID NO: 24680 - protein, 469 aa, Artificial Sequence; identical to SEQ ID NO: 14712
  neuraminidase__InfluenzaA__AHL91169

SEQ ID NO: 24681 - protein, 469 aa, Artificial Sequence; identical to SEQ ID NO: 22146
  neuraminidase__InfluenzaA__AHL94987

SEQ ID NO: 24682 - protein, 469 aa, Artificial Sequence; identical to SEQ ID NO: 22146
  neuraminidase__InfluenzaA__AHL94999

SEQ ID NO: 24683 - protein, 469 aa, Artificial Sequence
  neuraminidase__InfluenzaA__AHL95011
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSRYVCSGLVGDTPRKNDSSSSSHCLDPNNEEGGHGVKGWAFDDGNDVWMGRTINETSRLGYETFKVIEGWFNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24684 - protein, 469 aa, Artificial Sequence; identical to SEQ ID NO: 23903
  neuraminidase__InfluenzaA__AHL95023

SEQ ID NO: 24685 - protein, 469 aa, Artificial Sequence; identical to SEQ ID NO: 22146
  neuraminidase__InfluenzaA__AHL95035

SEQ ID NO: 24686 - protein, 469 aa, Artificial Sequence; identical to SEQ ID NO: 22146
  neuraminidase__InfluenzaA__AHL95047

SEQ ID NO: 24687 - protein, 469 aa, Artificial Sequence; identical to SEQ ID NO: 23894
  neuraminidase__InfluenzaA__AHL95059

SEQ ID NO: 24688 - protein, 469 aa, Artificial Sequence; identical to SEQ ID NO: 22146
  neuraminidase__InfluenzaA__AHL95071

SEQ ID NO: 24689 - protein, 469 aa, Artificial Sequence; identical to SEQ ID NO: 22146
  neuraminidase__InfluenzaA__AHL95083

SEQ ID NO: 24690 - protein, 469 aa, Artificial Sequence; identical to SEQ ID NO: 22146
  neuraminidase__InfluenzaA__AHL95095

SEQ ID NO: 24691 - protein, 469 aa, Artificial Sequence; identical to SEQ ID NO: 22146
  neuraminidase__InfluenzaA__AHL95107

SEQ ID NO: 24692 - protein, 469 aa, Artificial Sequence
  neuraminidase__InfluenzaA__AHL95119
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSRYVCSGLVGDTPRKNDSLSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24693 - protein, 469 aa, Artificial Sequence; identical to SEQ ID NO: 23375
  neuraminidase__InfluenzaA__AHL95131

SEQ ID NO: 24694 - protein, 469 aa, Artificial Sequence; identical to SEQ ID NO: 23883
  neuraminidase__InfluenzaA__AHL95143

SEQ ID NO: 24695 - protein, 469 aa, Artificial Sequence
  neuraminidase__InfluenzaA__AHL95155
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGSHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24696 - protein, 469 aa, Artificial Sequence
  neuraminidase__InfluenzaA__AHL95167
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSRYLCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24697 - protein, 469 aa, Artificial Sequence; identical to SEQ ID NO: 22146
  neuraminidase__InfluenzaA__AHL95179

SEQ ID NO: 24698 - protein, 469 aa, Artificial Sequence; identical to SEQ ID NO: 22146
  neuraminidase__InfluenzaA__AHL95191

SEQ ID NO: 24699 - protein, 469 aa, Artificial Sequence; identical to SEQ ID NO: 22146
  neuraminidase__InfluenzaA__AHL95203

SEQ ID NO: 24700 - protein, 469 aa, Artificial Sequence; identical to SEQ ID NO: 22146
  neuraminidase__InfluenzaA__AHL95215

SEQ ID NO: 24701 - protein, 469 aa, Artificial Sequence
  neuraminidase__InfluenzaA__AHL95227
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRENDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24702 - protein, 469 aa, Artificial Sequence; identical to SEQ ID NO: 23883
  neuraminidase__InfluenzaA__AHL95239

SEQ ID NO: 24703 - protein, 469 aa, Artificial Sequence
  neuraminidase__InfluenzaA__AHL95251
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIKEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24704 - protein, 469 aa, Artificial Sequence; identical to SEQ ID NO: 22146
  neuraminidase__InfluenzaA__AHL95263

SEQ ID NO: 24705 - protein, 469 aa, Artificial Sequence
  neuraminidase__InfluenzaA__AHL95275
MNPNQKIITIGSVSLTISTICFFMQIAILITTVTLHFKQYEFNSPPNNQVMLCEPTIIERNITEIVYLTNITIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24706 - protein, 469 aa, Artificial Sequence; identical to SEQ ID NO: 23389
  neuraminidase__InfluenzaA__AHL95299

SEQ ID NO: 24707 - protein, 469 aa, Artificial Sequence
  neuraminidase__InfluenzaA__AHL95310
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSRYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGANLNLMPI

SEQ ID NO: 24708 - protein, 469 aa, Artificial Sequence; identical to SEQ ID NO: 23894
  neuraminidase__InfluenzaA__AHL95322

SEQ ID NO: 24709 - protein, 469 aa, Artificial Sequence; identical to SEQ ID NO: 23871
  neuraminidase__InfluenzaA__AHL95334

SEQ ID NO: 24710 - protein, 469 aa, Artificial Sequence; identical to SEQ ID NO: 22146
  neuraminidase__InfluenzaA__AHL95423

SEQ ID NO: 24711 - protein, 469 aa, Artificial Sequence; identical to SEQ ID NO: 23894
  neuraminidase__InfluenzaA__AHL95435

SEQ ID NO: 24712 - protein, 469 aa, Artificial Sequence; identical to SEQ ID NO: 23871
  neuraminidase__InfluenzaA__AHL95447

SEQ ID NO: 24713 - protein, 469 aa, Artificial Sequence
  neuraminidase__InfluenzaA__AHL95461
MNPNQKIITIGSVSLTISTICFFMQIAILITTVTLHFKQYEFNPPPNNQVMLCEPTIIERNITEIVYLTNTTIEKEICPKPAEYRNWSKPQCGITGFAPFSKDNSIRLSAGGDIWVTREPYVSCGPDKCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24714 - protein, 469 aa, Artificial Sequence; identical to SEQ ID NO: 22922
  neuraminidase__InfluenzaA__AHL95473

SEQ ID NO: 24715 - protein, 469 aa, Artificial Sequence; identical to SEQ ID NO: 22146
  neuraminidase__InfluenzaA__AHL95485

SEQ ID NO: 24716 - protein, 469 aa, Artificial Sequence; identical to SEQ ID NO: 22146
  neuraminidase__InfluenzaA__AHL95497

SEQ ID NO: 24717 - protein, 469 aa, Artificial Sequence
  neuraminidase__InfluenzaA__AHL95509
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKNHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24718 - protein, 469 aa, Artificial Sequence; identical to SEQ ID NO: 22146
  neuraminidase__InfluenzaA__AHL95521

SEQ ID NO: 24719 - protein, 469 aa, Artificial Sequence; identical to SEQ ID NO: 22146
  neuraminidase__InfluenzaA__AHL95533

SEQ ID NO: 24720 - protein, 469 aa, Artificial Sequence; identical to SEQ ID NO: 22146
  neuraminidase__InfluenzaA__AHL95545

SEQ ID NO: 24721 - protein, 469 aa, Artificial Sequence
  neuraminidase__InfluenzaA__AHL95557
MNPNQKIITIGSVSLTISTICFFIQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTARDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPESKLQINRQVIVDRGDRSGYSGIFSVEGKSCINRCFYVELIRGRKEETEVLWTSNSIVVFCGTSGTYGTGSWPDGADLNLMPI

SEQ ID NO: 24722 - protein, 469 aa, Artificial Sequence; identical to SEQ ID NO: 23871
  neuraminidase__InfluenzaA__AHL95569

SEQ ID NO: 24723 - protein, 469 aa, Artificial Sequence; identical to SEQ ID NO: 22146
  neuraminidase__InfluenzaA__AHL95581

SEQ ID NO: 24724 - protein, 469 aa, Artificial Sequence
  neuraminidase__InfluenzaA__AHL95605
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDISSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24725 - protein, 469 aa, Artificial Sequence; identical to SEQ ID NO: 22146
  neuraminidase__InfluenzaA__AHL95617

SEQ ID NO: 24726 - protein, 469 aa, Artificial Sequence; identical to SEQ ID NO: 22146
  neuraminidase__InfluenzaA__AHL95629

SEQ ID NO: 24727 - protein, 469 aa, Artificial Sequence; identical to SEQ ID NO: 22146
  neuraminidase__InfluenzaA__AHL95641

SEQ ID NO: 24728 - protein, 469 aa, Artificial Sequence; identical to SEQ ID NO: 22146
  neuraminidase__InfluenzaA__AHL95653

SEQ ID NO: 24729 - protein, 469 aa, Artificial Sequence; identical to SEQ ID NO: 24724
  neuraminidase__InfluenzaA__AHL95665

SEQ ID NO: 24730 - protein, 469 aa, Artificial Sequence; identical to SEQ ID NO: 22146
  neuraminidase__InfluenzaA__AHL95677

SEQ ID NO: 24731 - protein, 469 aa, Artificial Sequence
  neuraminidase__InfluenzaA__AHL95689
MNPNQKIITIGSVSLTISTICFFMQIAILITTVTLHFKQYEFDSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGANLNLMPI

SEQ ID NO: 24732 - protein, 469 aa, Artificial Sequence; identical to SEQ ID NO: 22146
  neuraminidase__InfluenzaA__AHL95701

SEQ ID NO: 24733 - protein, 469 aa, Artificial Sequence; identical to SEQ ID NO: 22146
  neuraminidase__InfluenzaA__AHL95713

SEQ ID NO: 24734 - protein, 469 aa, Artificial Sequence
  neuraminidase__InfluenzaA__AHL95725
MNPNQKIITIGSVSLTISTICFFMQIAILITTVTLHFKQYEFDPPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEEIEVLWTSNSIVVFCGTSGTYGTGSWPDGADLNLMPI

SEQ ID NO: 24735 - protein, 469 aa, Artificial Sequence; identical to SEQ ID NO: 23883
  neuraminidase__InfluenzaA__AHL95737

SEQ ID NO: 24736 - protein, 469 aa, Artificial Sequence
  neuraminidase__InfluenzaA__AHL95749
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTARDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24737 - protein, 469 aa, Artificial Sequence; identical to SEQ ID NO: 22146
  neuraminidase__InfluenzaA__AHL95761

SEQ ID NO: 24738 - protein, 469 aa, Artificial Sequence; identical to SEQ ID NO: 22146
  neuraminidase__InfluenzaA__AHL95773

SEQ ID NO: 24739 - protein, 469 aa, Artificial Sequence
  neuraminidase__InfluenzaA__AHL95785
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSVRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24740 - protein, 469 aa, Artificial Sequence; identical to SEQ ID NO: 23871
  neuraminidase__InfluenzaA__AHL95797

SEQ ID NO: 24741 - protein, 469 aa, Artificial Sequence; identical to SEQ ID NO: 22146
  neuraminidase__InfluenzaA__AHL95833

SEQ ID NO: 24742 - protein, 469 aa, Artificial Sequence; identical to SEQ ID NO: 23871
  neuraminidase__InfluenzaA__AHL95845

SEQ ID NO: 24743 - protein, 469 aa, Artificial Sequence
  neuraminidase__InfluenzaA__AHL95857
MNPNQKIISIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24744 - protein, 469 aa, Artificial Sequence; identical to SEQ ID NO: 22146
  neuraminidase__InfluenzaA__AHL95869

SEQ ID NO: 24745 - protein, 469 aa, Artificial Sequence
  neuraminidase__InfluenzaA__AHL95881
MNPNQKIITIGSVCMTIGMANLILQIGNIISIWISHSIQVGNQSQIETCNQSVITYENNTWVNQTYVNISNTNLAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 24746 - protein, 469 aa, Artificial Sequence
  neuraminidase__InfluenzaA__AHL95892
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSRYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24747 - protein, 469 aa, Artificial Sequence; identical to SEQ ID NO: 22146
  neuraminidase__InfluenzaA__AHL95904

SEQ ID NO: 24748 - protein, 469 aa, Artificial Sequence
  neuraminidase__InfluenzaA__AHL95916
MNPNQKIITIGSVSLTISTICFFMQIAILITTVTLHFKQYELNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24749 - protein, 469 aa, Artificial Sequence; identical to SEQ ID NO: 23883
  neuraminidase__InfluenzaA__AHL95928

SEQ ID NO: 24750 - protein, 469 aa, Artificial Sequence; identical to SEQ ID NO: 23871
  neuraminidase__InfluenzaA__AHL95940

SEQ ID NO: 24751 - protein, 469 aa, Artificial Sequence; identical to SEQ ID NO: 22146
  neuraminidase__InfluenzaA__AHL95952

SEQ ID NO: 24752 - protein, 469 aa, Artificial Sequence; identical to SEQ ID NO: 22146
  neuraminidase__InfluenzaA__AHL95964

SEQ ID NO: 24753 - protein, 469 aa, Artificial Sequence; identical to SEQ ID NO: 22146
  neuraminidase__InfluenzaA__AHL95976

SEQ ID NO: 24754 - protein, 469 aa, Artificial Sequence; identical to SEQ ID NO: 22146
  neuraminidase__InfluenzaA__AHL95988

SEQ ID NO: 24755 - protein, 469 aa, Artificial Sequence; identical to SEQ ID NO: 22146
  neuraminidase__InfluenzaA__AHL96000

SEQ ID NO: 24756 - protein, 469 aa, Artificial Sequence
  neuraminidase__InfluenzaA__AHL96012
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTRVPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24757 - protein, 469 aa, Artificial Sequence
  neuraminidase__InfluenzaA__AHL96024
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKENLRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24758 - protein, 469 aa, Artificial Sequence; identical to SEQ ID NO: 22146
  neuraminidase__InfluenzaA__AHL96036

SEQ ID NO: 24759 - protein, 469 aa, Artificial Sequence; identical to SEQ ID NO: 23389
  neuraminidase__InfluenzaA__AHL96048

SEQ ID NO: 24760 - protein, 469 aa, Artificial Sequence; identical to SEQ ID NO: 22146
  neuraminidase__InfluenzaA__AHL96059

SEQ ID NO: 24761 - protein, 469 aa, Artificial Sequence; identical to SEQ ID NO: 23883
  neuraminidase__InfluenzaA__AHL96071

SEQ ID NO: 24762 - protein, 469 aa, Artificial Sequence; identical to SEQ ID NO: 24724
  neuraminidase__InfluenzaA__AHL96083

SEQ ID NO: 24763 - protein, 469 aa, Artificial Sequence; identical to SEQ ID NO: 22146
  neuraminidase__InfluenzaA__AHL96095

SEQ ID NO: 24764 - protein, 469 aa, Artificial Sequence
  neuraminidase__InfluenzaA__AHL96107
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDNSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24765 - protein, 469 aa, Artificial Sequence; identical to SEQ ID NO: 22146
  neuraminidase__InfluenzaA__AHL96119

SEQ ID NO: 24766 - protein, 469 aa, Artificial Sequence; identical to SEQ ID NO: 23883
  neuraminidase__InfluenzaA__AHL96131

SEQ ID NO: 24767 - protein, 469 aa, Artificial Sequence; identical to SEQ ID NO: 22146
  neuraminidase__InfluenzaA__AHL96143

SEQ ID NO: 24768 - protein, 469 aa, Artificial Sequence; identical to SEQ ID NO: 22146
  neuraminidase__InfluenzaA__AHL96167

SEQ ID NO: 24769 - protein, 469 aa, Artificial Sequence; identical to SEQ ID NO: 22146
  neuraminidase__InfluenzaA__AHL96179

SEQ ID NO: 24770 - protein, 469 aa, Artificial Sequence
  neuraminidase__InfluenzaA__AHL96191
MNPNQKIITIGSVSLTISTICFFMQIAILITTVTLHFKQYEFDSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24771 - protein, 469 aa, Artificial Sequence; identical to SEQ ID NO: 23871
  neuraminidase__InfluenzaA__AHL96203

SEQ ID NO: 24772 - protein, 469 aa, Artificial Sequence; identical to SEQ ID NO: 23883
  neuraminidase__InfluenzaA__AHL96215

SEQ ID NO: 24773 - protein, 469 aa, Artificial Sequence; identical to SEQ ID NO: 22146
  neuraminidase__InfluenzaA__AHL96227

SEQ ID NO: 24774 - protein, 469 aa, Artificial Sequence; identical to SEQ ID NO: 22146
  neuraminidase__InfluenzaA__AHL96239

SEQ ID NO: 24775 - protein, 469 aa, Artificial Sequence; identical to SEQ ID NO: 22146
  neuraminidase__InfluenzaA__AHL96251

SEQ ID NO: 24776 - protein, 469 aa, Artificial Sequence; identical to SEQ ID NO: 22146
  neuraminidase__InfluenzaA__AHL96263

SEQ ID NO: 24777 - protein, 469 aa, Artificial Sequence; identical to SEQ ID NO: 23927
  neuraminidase__InfluenzaA__AHL96277

SEQ ID NO: 24778 - protein, 469 aa, Artificial Sequence
  neuraminidase__InfluenzaA__AHL96308
MNPNQKIITIGSVSLTISTICFFMQIAILITTVTLHFKQYEFNFPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMSELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24779 - protein, 469 aa, Artificial Sequence; identical to SEQ ID NO: 23375
  neuraminidase__InfluenzaA__AHL96321

SEQ ID NO: 24780 - protein, 469 aa, Artificial Sequence; identical to SEQ ID NO: 22146
  neuraminidase__InfluenzaA__AHL96333

SEQ ID NO: 24781 - protein, 469 aa, Artificial Sequence
  neuraminidase__InfluenzaA__AHL96345
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDNSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24782 - protein, 469 aa, Artificial Sequence; identical to SEQ ID NO: 23871
  neuraminidase__InfluenzaA__AHL96357

SEQ ID NO: 24783 - protein, 469 aa, Artificial Sequence; identical to SEQ ID NO: 22146
  neuraminidase__InfluenzaA__AHL96369

SEQ ID NO: 24784 - protein, 469 aa, Artificial Sequence; identical to SEQ ID NO: 22146
  neuraminidase__InfluenzaA__AHL96381

SEQ ID NO: 24785 - protein, 469 aa, Artificial Sequence; identical to SEQ ID NO: 23883
  neuraminidase__InfluenzaA__AHL96393

SEQ ID NO: 24786 - protein, 469 aa, Artificial Sequence
  neuraminidase__InfluenzaA__AHL96405
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLGPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24787 - protein, 469 aa, Artificial Sequence; identical to SEQ ID NO: 22146
  neuraminidase__InfluenzaA__AHL96417

SEQ ID NO: 24788 - protein, 469 aa, Artificial Sequence; identical to SEQ ID NO: 22146
  neuraminidase__InfluenzaA__AHL96429

SEQ ID NO: 24789 - protein, 469 aa, Artificial Sequence
  neuraminidase__InfluenzaA__AHL96441
MNPNQKIITIGSVSLTISTICFFMQIAILITTVTLHFKHYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSRYVCSGLVGDTPRKNDSSSSSHCLNPNNEEGGHGVKGWAFDDGNDVWMGRTINETSRLGYETFKVIEGWSNPKSKLQINRQIIVDRGDRSGYSGIFSVEGKSCINRCFYVELIRGRKEETEVLWTSNSIVVFCGTSGTYGTGSWPDGADLNLMPI

SEQ ID NO: 24790 - protein, 469 aa, Artificial Sequence; identical to SEQ ID NO: 22146
  neuraminidase__InfluenzaA__AHL96453

SEQ ID NO: 24791 - protein, 469 aa, Artificial Sequence; identical to SEQ ID NO: 22146
  neuraminidase__InfluenzaA__AHL96465

SEQ ID NO: 24792 - protein, 469 aa, Artificial Sequence
  neuraminidase__InfluenzaA__AHL96477
MNPNQKIITIGSVCMTIGMANLILQIGNIISIWISHSIQVGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 24793 - protein, 469 aa, Artificial Sequence; identical to SEQ ID NO: 23883
  neuraminidase__InfluenzaA__AHL96488

SEQ ID NO: 24794 - protein, 469 aa, Artificial Sequence; identical to SEQ ID NO: 22146
  neuraminidase__InfluenzaA__AHL96500

SEQ ID NO: 24795 - protein, 469 aa, Artificial Sequence; identical to SEQ ID NO: 22146
  neuraminidase__InfluenzaA__AHL96512

SEQ ID NO: 24796 - protein, 469 aa, Artificial Sequence; identical to SEQ ID NO: 23375
  neuraminidase__InfluenzaA__AHL96524

SEQ ID NO: 24797 - protein, 469 aa, Artificial Sequence
  neuraminidase__InfluenzaA__AHL96536
MNPNQKIITIGSVSLTISTICFFTQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTINNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24798 - protein, 469 aa, Artificial Sequence; identical to SEQ ID NO: 23883
  neuraminidase__InfluenzaA__AHL96548

SEQ ID NO: 24799 - protein, 469 aa, Artificial Sequence
  neuraminidase__InfluenzaA__AHL96560
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGNASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24800 - protein, 469 aa, Artificial Sequence; identical to SEQ ID NO: 23357
  neuraminidase__InfluenzaA__AHL96572

SEQ ID NO: 24801 - protein, 469 aa, Artificial Sequence; identical to SEQ ID NO: 24792
  neuraminidase__InfluenzaA__AHL96584

SEQ ID NO: 24802 - protein, 469 aa, Artificial Sequence
  neuraminidase__InfluenzaA__AHL96595
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVESKSCINRCFYVELIRGRKEETEVLWTSNSIVVFCGTSGTYGTGSWPDGADLNLMPI

SEQ ID NO: 24803 - protein, 469 aa, Artificial Sequence; identical to SEQ ID NO: 22146
  neuraminidase__InfluenzaA__AHL96607

SEQ ID NO: 24804 - protein, 469 aa, Artificial Sequence
  neuraminidase__InfluenzaA__AHL96631
MNPNQKIITIGSVSLTISTICFFMQIAILITTVTLHFKQYEFNSLPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24805 - protein, 469 aa, Artificial Sequence; identical to SEQ ID NO: 23883
  neuraminidase__InfluenzaA__AHL96643

SEQ ID NO: 24806 - protein, 469 aa, Artificial Sequence; identical to SEQ ID NO: 22146
  neuraminidase__InfluenzaA__AHL96655

SEQ ID NO: 24807 - protein, 469 aa, Artificial Sequence; identical to SEQ ID NO: 22146
  neuraminidase__InfluenzaA__AHL96667

SEQ ID NO: 24808 - protein, 469 aa, Artificial Sequence; identical to SEQ ID NO: 22146
  neuraminidase__InfluenzaA__AHL96679

SEQ ID NO: 24809 - protein, 469 aa, Artificial Sequence; identical to SEQ ID NO: 22146
  neuraminidase__InfluenzaA__AHL96691

SEQ ID NO: 24810 - protein, 469 aa, Artificial Sequence; identical to SEQ ID NO: 22146
  neuraminidase__InfluenzaA__AHL96703

SEQ ID NO: 24811 - protein, 469 aa, Artificial Sequence; identical to SEQ ID NO: 23871
  neuraminidase__InfluenzaA__AHL96763

SEQ ID NO: 24812 - protein, 469 aa, Artificial Sequence; identical to SEQ ID NO: 24724
  neuraminidase__InfluenzaA__AHL96787

SEQ ID NO: 24813 - protein, 469 aa, Artificial Sequence
  neuraminidase__InfluenzaA__AHL96799
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKDETEVLWTSNSIVVFCGTSGTYGTGSWPDGADLNLMPI

SEQ ID NO: 24814 - protein, 469 aa, Artificial Sequence; identical to SEQ ID NO: 23883
  neuraminidase__InfluenzaA__AHL96811

SEQ ID NO: 24815 - protein, 469 aa, Artificial Sequence; identical to SEQ ID NO: 23883
  neuraminidase__InfluenzaA__AHL96823

SEQ ID NO: 24816 - protein, 469 aa, Artificial Sequence; identical to SEQ ID NO: 22146
  neuraminidase__InfluenzaA__AHL96847

SEQ ID NO: 24817 - protein, 469 aa, Artificial Sequence
  neuraminidase__InfluenzaA__AHL96859
MNPNQKIITIGSVSLTISTICFFMQIAILITTVTLHFKQYEFNSPPNNQMMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24818 - protein, 469 aa, Artificial Sequence
  neuraminidase__InfluenzaA__AHL96871
MNPNQKIITIGSVSLTISTICFFMQIAILITTVTLHFKQYEFNSPPNNQVMLCEPTIVERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEVLRTQESECVCINGTCAVVMTDGSASGKADTKILFIEEGKIVHTSTLSGSAQHVEECSCYPRYPGVRCVCRDNWKGSNRPIVDINIKDHSIVSSYVCSGLVGDTPRKNDRSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24819 - protein, 469 aa, Artificial Sequence
  neuraminidase__InfluenzaA__AHL96883
MNPNQKIITIGSVSLTISTICFFMQIAILITTVTLHFKQYEFNSPPNNQVMLCEPTIIERNITEIVYLTNTTIEKEICPKSAEYRNWSKPQCGITGFAPFSKDNSIRLSAGGDIWVTREPYVSCDPDKCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24820 - protein, 469 aa, Artificial Sequence; identical to SEQ ID NO: 23871
  neuraminidase__InfluenzaA__AHL96895

SEQ ID NO: 24821 - protein, 469 aa, Artificial Sequence
  neuraminidase__InfluenzaA__AHL96907
MNPNQKIITIGSVSLTISTICFFMQIAILITTVTLHFKQYEFNSPPNNQVMLCEPTIVERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEVLRTQESECVCINGTCAVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24822 - protein, 469 aa, Artificial Sequence; identical to SEQ ID NO: 23883
  neuraminidase__InfluenzaA__AHL96919

SEQ ID NO: 24823 - protein, 469 aa, Artificial Sequence; identical to SEQ ID NO: 23883
  neuraminidase__InfluenzaA__AHL96931

SEQ ID NO: 24824 - protein, 469 aa, Artificial Sequence; identical to SEQ ID NO: 23883
  neuraminidase__InfluenzaA__AHL96943

SEQ ID NO: 24825 - protein, 469 aa, Artificial Sequence
  neuraminidase__InfluenzaA__AHL96955
MNPNQKIITIGSVSLTISTICFFMQIAILITTVTLHFKQYEFNSPSNNQVMLCEPTIIERNITEIVYLTNTTIEKEICPKPAEYRNWSKPQCGITGFAPFSKDNSIRLSAGGNIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24826 - protein, 469 aa, Artificial Sequence; identical to SEQ ID NO: 24724
  neuraminidase__InfluenzaA__AHL96967

SEQ ID NO: 24827 - protein, 469 aa, Artificial Sequence
  neuraminidase__InfluenzaA__AHL96979
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNIMPI

SEQ ID NO: 24828 - protein, 469 aa, Artificial Sequence; identical to SEQ ID NO: 23883
  neuraminidase__InfluenzaA__AHL96991

SEQ ID NO: 24829 - protein, 469 aa, Artificial Sequence; identical to SEQ ID NO: 22146
  neuraminidase__InfluenzaA__AHL97003

SEQ ID NO: 24830 - protein, 469 aa, Artificial Sequence
  neuraminidase__InfluenzaA__AHL97015
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQIIVDRGDRSGYSGIFSVEGKSCINRCFYVELIRGRKEETEVLWTSNSIVVFCGTSGTYGTGSWPDGADLNLMPI

SEQ ID NO: 24831 - protein, 469 aa, Artificial Sequence; identical to SEQ ID NO: 22146
  neuraminidase__InfluenzaA__AHL97027

SEQ ID NO: 24832 - protein, 469 aa, Artificial Sequence
  neuraminidase__InfluenzaA__AHL97039
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGNASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24833 - protein, 469 aa, Artificial Sequence; identical to SEQ ID NO: 22146
  neuraminidase__InfluenzaA__AHL97051

SEQ ID NO: 24834 - protein, 469 aa, Artificial Sequence
  neuraminidase__InfluenzaA__AHL97063
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLGPNNEEGGHGVKGWAFDDGNDVWMGRTINETSRLGYETFKVIDGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24835 - protein, 469 aa, Artificial Sequence; identical to SEQ ID NO: 22146
  neuraminidase__InfluenzaA__AHL97075

SEQ ID NO: 24836 - protein, 469 aa, Artificial Sequence; identical to SEQ ID NO: 23871
  neuraminidase__InfluenzaA__AHL97087

SEQ ID NO: 24837 - protein, 469 aa, Artificial Sequence; identical to SEQ ID NO: 23375
  neuraminidase__InfluenzaA__AHL97099

SEQ ID NO: 24838 - protein, 469 aa, Artificial Sequence; identical to SEQ ID NO: 22146
  neuraminidase__InfluenzaA__AHL97111

SEQ ID NO: 24839 - protein, 469 aa, Artificial Sequence
  neuraminidase__InfluenzaA__AHL97123
MNPNQKIITIGSVSLTISTICFFMQIAILITTVTLHFKQYEFDSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRRNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24840 - protein, 469 aa, Artificial Sequence; identical to SEQ ID NO: 23903
  neuraminidase__InfluenzaA__AHL97135

SEQ ID NO: 24841 - protein, 469 aa, Artificial Sequence
  neuraminidase__InfluenzaA__AHL97147
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWRGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24842 - protein, 469 aa, Artificial Sequence; identical to SEQ ID NO: 22146
  neuraminidase__InfluenzaA__AHL97159

SEQ ID NO: 24843 - protein, 469 aa, Artificial Sequence; identical to SEQ ID NO: 22146
  neuraminidase__InfluenzaA__AHL97171

SEQ ID NO: 24844 - protein, 469 aa, Artificial Sequence; identical to SEQ ID NO: 22146
  neuraminidase__InfluenzaA__AHL97183

SEQ ID NO: 24845 - protein, 469 aa, Artificial Sequence; identical to SEQ ID NO: 22146
  neuraminidase__InfluenzaA__AHL97195

SEQ ID NO: 24846 - protein, 469 aa, Artificial Sequence; identical to SEQ ID NO: 22146
  neuraminidase__InfluenzaA__AHL97207

SEQ ID NO: 24847 - protein, 469 aa, Artificial Sequence; identical to SEQ ID NO: 22146
  neuraminidase__InfluenzaA__AHL97219

SEQ ID NO: 24848 - protein, 469 aa, Artificial Sequence
  neuraminidase__InfluenzaA__AHL97231
MNPNQKIITIGSVSLTISTICFFMQIAILITTVTLHFKQYDFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSVISSYVCSGLVGDTPRKNDSSSSSHCLDPNNEEGGHGVKGWAFDDGNDVWMGRTINETSRLGYETFKVIGGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24849 - protein, 469 aa, Artificial Sequence
  neuraminidase__InfluenzaA__AHL97243
MNPNQKIITIGSVSLTISTICFFMQIAILITTVTLNFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24850 - protein, 469 aa, Artificial Sequence; identical to SEQ ID NO: 23375
  neuraminidase__InfluenzaA__AHL97255

SEQ ID NO: 24851 - protein, 469 aa, Artificial Sequence
  neuraminidase__InfluenzaA__AHL97267
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTARDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSFSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24852 - protein, 469 aa, Artificial Sequence; identical to SEQ ID NO: 22146
  neuraminidase__InfluenzaA__AHL97279

SEQ ID NO: 24853 - protein, 469 aa, Artificial Sequence; identical to SEQ ID NO: 24736
  neuraminidase__InfluenzaA__AHL97291

SEQ ID NO: 24854 - protein, 469 aa, Artificial Sequence; identical to SEQ ID NO: 24724
  neuraminidase__InfluenzaA__AHL97303

SEQ ID NO: 24855 - protein, 469 aa, Artificial Sequence
  neuraminidase__InfluenzaA__AHL97339
MNPNQKIITIGSVSLTISTICFFMQIAILITTVTLHFKQYEFDSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTSYRTLLMNELGVPFHLGTKQVCIAWSSSSCHDGKAWLHVCITGDDKNATASFIYNGRLVDSVVSWSKEILRTQESECVCINGTCTVVMTDGSASGRADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24856 - protein, 469 aa, Artificial Sequence; identical to SEQ ID NO: 23871
  neuraminidase__InfluenzaA__AHL97351

SEQ ID NO: 24857 - protein, 469 aa, Artificial Sequence; identical to SEQ ID NO: 24736
  neuraminidase__InfluenzaA__AHL97363

SEQ ID NO: 24858 - protein, 469 aa, Artificial Sequence; identical to SEQ ID NO: 22146
  neuraminidase__InfluenzaA__AHL97387

SEQ ID NO: 24859 - protein, 469 aa, Artificial Sequence
  neuraminidase__InfluenzaA__AHL97399
MNPNQKIITIGSVSLTISTICFFMQIAILITTVTLHFKQYEFNSPPNNQVMLCEPTIIERNITEIMYLTNTTIEKEICPKPAEYRNWSKPQCGITGFAPFSKDNSIRLSAGGDIWVTREPYVSCDPDKCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGRSCINRCFYVELIRGRKEETEVLWTSNSIVVFCGTSGTYGTGSWPDGADLNLMPI

SEQ ID NO: 24860 - protein, 469 aa, Artificial Sequence; identical to SEQ ID NO: 23375
  neuraminidase__InfluenzaA__AHL97411

SEQ ID NO: 24861 - protein, 469 aa, Artificial Sequence
  neuraminidase__InfluenzaA__AHL97423
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDMWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24862 - protein, 469 aa, Artificial Sequence
  neuraminidase__InfluenzaA__AHL97447
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSFSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24863 - protein, 469 aa, Artificial Sequence; identical to SEQ ID NO: 22146
  neuraminidase__InfluenzaA__AHL97459

SEQ ID NO: 24864 - protein, 469 aa, Artificial Sequence; identical to SEQ ID NO: 24736
  neuraminidase__InfluenzaA__AHL97471

SEQ ID NO: 24865 - protein, 469 aa, Artificial Sequence; identical to SEQ ID NO: 23871
  neuraminidase__InfluenzaA__AHL97483

SEQ ID NO: 24866 - protein, 469 aa, Artificial Sequence; identical to SEQ ID NO: 22146
  neuraminidase__InfluenzaA__AHL97496

SEQ ID NO: 24867 - protein, 469 aa, Artificial Sequence; identical to SEQ ID NO: 22146
  neuraminidase__InfluenzaA__AHL97508

SEQ ID NO: 24868 - protein, 469 aa, Artificial Sequence
  neuraminidase__InfluenzaA__AHL97520
MNPNQKIITIGSVSLTISTICFFMQIAILITTVTLHFKQYEFNSPPNNQVMLCEPTIIERNITEIVYLTNTTIEKETCPKPAEYRNWSKPQCGITGFAPFSKDNSIRLSAGGDIWVTREPYVSCGPDKCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24869 - protein, 469 aa, Artificial Sequence; identical to SEQ ID NO: 22146
  neuraminidase__InfluenzaA__AHL97532

SEQ ID NO: 24870 - protein, 469 aa, Artificial Sequence; identical to SEQ ID NO: 22146
  neuraminidase__InfluenzaA__AHL97544

SEQ ID NO: 24871 - protein, 469 aa, Artificial Sequence; identical to SEQ ID NO: 23871
  neuraminidase__InfluenzaA__AHL97556

SEQ ID NO: 24872 - protein, 469 aa, Artificial Sequence
  neuraminidase__InfluenzaA__AHL97568
MNPNQKIITIGSVSLTISAICFFMQIAILITTVTLRFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLTNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSRYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24873 - protein, 469 aa, Artificial Sequence; identical to SEQ ID NO: 24786
  neuraminidase__InfluenzaA__AHL97580

SEQ ID NO: 24874 - protein, 469 aa, Artificial Sequence
  neuraminidase__InfluenzaA__AHL97592
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSVRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLGPNNEEGGHGVKGWAFDDGNDVWMGRTINETSRSGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24875 - protein, 469 aa, Artificial Sequence; identical to SEQ ID NO: 22146
  neuraminidase__InfluenzaA__AHL97604

SEQ ID NO: 24876 - protein, 469 aa, Artificial Sequence
  neuraminidase__InfluenzaA__AHL97616
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNMHSNNTVRDRTPYRTLLMNELGVPFHLGTKQVCIAWSSSSCHDGKAWLHVCITGDDKNATASFIYNGRLVDSVVSWSKEVLRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24877 - protein, 469 aa, Artificial Sequence; identical to SEQ ID NO: 24736
  neuraminidase__InfluenzaA__AHL97628

SEQ ID NO: 24878 - protein, 469 aa, Artificial Sequence; identical to SEQ ID NO: 22146
  neuraminidase__InfluenzaA__AHL97640

SEQ ID NO: 24879 - protein, 469 aa, Artificial Sequence; identical to SEQ ID NO: 23894
  neuraminidase__InfluenzaA__AHL97652

SEQ ID NO: 24880 - protein, 469 aa, Artificial Sequence; identical to SEQ ID NO: 23894
  neuraminidase__InfluenzaA__AHL97664

SEQ ID NO: 24881 - protein, 469 aa, Artificial Sequence; identical to SEQ ID NO: 23375
  neuraminidase__InfluenzaA__AHL97676

SEQ ID NO: 24882 - protein, 469 aa, Artificial Sequence; identical to SEQ ID NO: 22146
  neuraminidase__InfluenzaA__AHL97688

SEQ ID NO: 24883 - protein, 469 aa, Artificial Sequence; identical to SEQ ID NO: 23871
  neuraminidase__InfluenzaA__AHL97700

SEQ ID NO: 24884 - protein, 469 aa, Artificial Sequence
  neuraminidase__InfluenzaA__AHL97712
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSTSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24885 - protein, 469 aa, Artificial Sequence; identical to SEQ ID NO: 23871
  neuraminidase__InfluenzaA__AHL97724

SEQ ID NO: 24886 - protein, 469 aa, Artificial Sequence; identical to SEQ ID NO: 22146
  neuraminidase__InfluenzaA__AHL97736

SEQ ID NO: 24887 - protein, 469 aa, Artificial Sequence
  neuraminidase__InfluenzaA__AHL97760
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDENATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24888 - protein, 469 aa, Artificial Sequence
  neuraminidase__InfluenzaA__AHL97772
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSVVVFCGTSGTYGTGSWPDGADLNLMPI

SEQ ID NO: 24889 - protein, 469 aa, Artificial Sequence; identical to SEQ ID NO: 23375
  neuraminidase__InfluenzaA__AHL97784

SEQ ID NO: 24890 - protein, 469 aa, Artificial Sequence; identical to SEQ ID NO: 22146
  neuraminidase__InfluenzaA__AHL97796

SEQ ID NO: 24891 - protein, 469 aa, Artificial Sequence; identical to SEQ ID NO: 22146
  neuraminidase__InfluenzaA__AHL97808

SEQ ID NO: 24892 - protein, 469 aa, Artificial Sequence; identical to SEQ ID NO: 22146
  neuraminidase__InfluenzaA__AHL97820

SEQ ID NO: 24893 - protein, 469 aa, Artificial Sequence
  neuraminidase__InfluenzaA__AHL97832
MNPNQKIITIGSVSLTISTICFFMQIAILITTVTLHFKQYEFDSPPNNQVMLCEPTIIERNITEIVYLTNTTIEKEICPKPAEYRSWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24894 - protein, 469 aa, Artificial Sequence; identical to SEQ ID NO: 22146
  neuraminidase__InfluenzaA__AHL97844

SEQ ID NO: 24895 - protein, 469 aa, Artificial Sequence; identical to SEQ ID NO: 24887
  neuraminidase__InfluenzaA__AHL97856

SEQ ID NO: 24896 - protein, 469 aa, Artificial Sequence; identical to SEQ ID NO: 22146
  neuraminidase__InfluenzaA__AHL97868

SEQ ID NO: 24897 - protein, 469 aa, Artificial Sequence; identical to SEQ ID NO: 23871
  neuraminidase__InfluenzaA__AHL97880

SEQ ID NO: 24898 - protein, 469 aa, Artificial Sequence; identical to SEQ ID NO: 22146
  neuraminidase__InfluenzaA__AHL97892

SEQ ID NO: 24899 - protein, 469 aa, Artificial Sequence; identical to SEQ ID NO: 22146
  neuraminidase__InfluenzaA__AHL97904

SEQ ID NO: 24900 - protein, 469 aa, Artificial Sequence; identical to SEQ ID NO: 23883
  neuraminidase__InfluenzaA__AHL97916

SEQ ID NO: 24901 - protein, 469 aa, Artificial Sequence; identical to SEQ ID NO: 22146
  neuraminidase__InfluenzaA__AHL97928

SEQ ID NO: 24902 - protein, 469 aa, Artificial Sequence; identical to SEQ ID NO: 24862
  neuraminidase__InfluenzaA__AHL97952

SEQ ID NO: 24903 - protein, 469 aa, Artificial Sequence; identical to SEQ ID NO: 22146
  neuraminidase__InfluenzaA__AHL97964

SEQ ID NO: 24904 - protein, 469 aa, Artificial Sequence; identical to SEQ ID NO: 22146
  neuraminidase__InfluenzaA__AHL97976

SEQ ID NO: 24905 - protein, 469 aa, Artificial Sequence; identical to SEQ ID NO: 22146
  neuraminidase__InfluenzaA__AHL97988

SEQ ID NO: 24906 - protein, 469 aa, Artificial Sequence
  neuraminidase__InfluenzaA__AHL98000
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTHESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKKDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24907 - protein, 469 aa, Artificial Sequence
  neuraminidase__InfluenzaA__AHL98012
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEVLRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGDHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24908 - protein, 469 aa, Artificial Sequence; identical to SEQ ID NO: 23883
  neuraminidase__InfluenzaA__AHL98048

SEQ ID NO: 24909 - protein, 469 aa, Artificial Sequence; identical to SEQ ID NO: 23883
  neuraminidase__InfluenzaA__AHL98060

SEQ ID NO: 24910 - protein, 469 aa, Artificial Sequence; identical to SEQ ID NO: 23883
  neuraminidase__InfluenzaA__AHL98072

SEQ ID NO: 24911 - protein, 469 aa, Artificial Sequence; identical to SEQ ID NO: 22146
  neuraminidase__InfluenzaA__AHL98084

SEQ ID NO: 24912 - protein, 469 aa, Artificial Sequence; identical to SEQ ID NO: 23883
  neuraminidase__InfluenzaA__AHL98096

SEQ ID NO: 24913 - protein, 469 aa, Artificial Sequence; identical to SEQ ID NO: 22146
  neuraminidase__InfluenzaA__AHL98119

SEQ ID NO: 24914 - protein, 469 aa, Artificial Sequence; identical to SEQ ID NO: 22146
  neuraminidase__InfluenzaA__AHL98131

SEQ ID NO: 24915 - protein, 469 aa, Artificial Sequence; identical to SEQ ID NO: 22146
  neuraminidase__InfluenzaA__AHL98143

SEQ ID NO: 24916 - protein, 469 aa, Artificial Sequence
  neuraminidase__InfluenzaA__AHL98155
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNSKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24917 - protein, 469 aa, Artificial Sequence; identical to SEQ ID NO: 22146
  neuraminidase__InfluenzaA__AHL98167

SEQ ID NO: 24918 - protein, 469 aa, Artificial Sequence; identical to SEQ ID NO: 22146
  neuraminidase__InfluenzaA__AHL98179

SEQ ID NO: 24919 - protein, 469 aa, Artificial Sequence; identical to SEQ ID NO: 22146
  neuraminidase__InfluenzaA__AHL98191

SEQ ID NO: 24920 - protein, 469 aa, Artificial Sequence; identical to SEQ ID NO: 23883
  neuraminidase__InfluenzaA__AHL98215

SEQ ID NO: 24921 - protein, 469 aa, Artificial Sequence
  neuraminidase__InfluenzaA__AHL98227
MNPNQKIITIGSVSLTISTICFFMQIAILITTVTLHFKQYEFNSPPNNQVMLCEPTIIERNITDIVYLTNTTIEKEICPKPAEYRNWSKPQCGITGFAPFSKDNSIRLSAGGDIWVTREPYVSCDPDKCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24922 - protein, 469 aa, Artificial Sequence; identical to SEQ ID NO: 22146
  neuraminidase__InfluenzaA__AHL98239

SEQ ID NO: 24923 - protein, 469 aa, Artificial Sequence; identical to SEQ ID NO: 22146
  neuraminidase__InfluenzaA__AHL98251

SEQ ID NO: 24924 - protein, 469 aa, Artificial Sequence; identical to SEQ ID NO: 23894
  neuraminidase__InfluenzaA__AHL98263

SEQ ID NO: 24925 - protein, 469 aa, Artificial Sequence; identical to SEQ ID NO: 22146
  neuraminidase__InfluenzaA__AHL98275

SEQ ID NO: 24926 - protein, 469 aa, Artificial Sequence; identical to SEQ ID NO: 24792
  neuraminidase__InfluenzaA__AHL98287

SEQ ID NO: 24927 - protein, 469 aa, Artificial Sequence
  neuraminidase__InfluenzaA__AHL98298
MNPNQKIITIGSVSLTISTICFFMQIAILITTVTLHFKQYEFNSPPNNQVMLCEPTIIGRNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24928 - protein, 469 aa, Artificial Sequence; identical to SEQ ID NO: 22146
  neuraminidase__InfluenzaA__AHL98310

SEQ ID NO: 24929 - protein, 469 aa, Artificial Sequence; identical to SEQ ID NO: 22146
  neuraminidase__InfluenzaA__AHL98322

SEQ ID NO: 24930 - protein, 469 aa, Artificial Sequence
  neuraminidase__InfluenzaA__AHL98334
MNPNQKIITIGSVSLTISTICFFMQIAILITTVTLHFKQYEFNSPPNNQVMLCEPTIIERNITEVVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24931 - protein, 469 aa, Artificial Sequence
  neuraminidase__InfluenzaA__AHL98346
MNPNQKIITIGSVSLTISTICFFMQIAILITTVTLHFKQYEFDSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEENEVLWTSNSIVVFCGTSGTYGTGSWPDGADLNLMPI

SEQ ID NO: 24932 - protein, 469 aa, Artificial Sequence; identical to SEQ ID NO: 22146
  neuraminidase__InfluenzaA__AHL98357

SEQ ID NO: 24933 - protein, 469 aa, Artificial Sequence; identical to SEQ ID NO: 23894
  neuraminidase__InfluenzaA__AHL98369

SEQ ID NO: 24934 - protein, 469 aa, Artificial Sequence
  neuraminidase__InfluenzaA__AHL98381
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCGPDKCYQFALGQGTTLNNMHSNNTVRDRTPYRTLLMSELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSTVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24935 - protein, 469 aa, Artificial Sequence
  neuraminidase__InfluenzaA__AHL98393
MNPNQKIITIGSVSLTISTICFFMQIAILITTVTLHFKQYEFNSPPNNQMMLCEPTIIERNITEIVYLTNTTIEKEICPKPAEYRNWSKPQCGITGFAPFSKDNSIRLSAGGDIWVTREPYVSCGPDKCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSDQHIEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24936 - protein, 469 aa, Artificial Sequence; identical to SEQ ID NO: 22146
  neuraminidase__InfluenzaA__AHL98405

SEQ ID NO: 24937 - protein, 469 aa, Artificial Sequence; identical to SEQ ID NO: 22146
  neuraminidase__InfluenzaA__AHL98417

SEQ ID NO: 24938 - protein, 469 aa, Artificial Sequence; identical to SEQ ID NO: 22146
  neuraminidase__InfluenzaA__AHL98429

SEQ ID NO: 24939 - protein, 469 aa, Artificial Sequence
  neuraminidase__InfluenzaA__AHL98452
MNPTQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWKNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 24940 - protein, 469 aa, Artificial Sequence
  neuraminidase__InfluenzaA__AHL98474
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPNSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 24941 - protein, 469 aa, Artificial Sequence
  neuraminidase__InfluenzaA__AHL98485
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSILSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24942 - protein, 469 aa, Artificial Sequence; identical to SEQ ID NO: 23375
  neuraminidase__InfluenzaA__AHL98497

SEQ ID NO: 24943 - protein, 469 aa, Artificial Sequence; identical to SEQ ID NO: 22146
  neuraminidase__InfluenzaA__AHL98509

SEQ ID NO: 24944 - protein, 469 aa, Artificial Sequence; identical to SEQ ID NO: 22146
  neuraminidase__InfluenzaA__AHL98521

SEQ ID NO: 24945 - protein, 469 aa, Artificial Sequence; identical to SEQ ID NO: 23375
  neuraminidase__InfluenzaA__AHL98533

SEQ ID NO: 24946 - protein, 469 aa, Artificial Sequence; identical to SEQ ID NO: 22146
  neuraminidase__InfluenzaA__AHL98545

SEQ ID NO: 24947 - protein, 469 aa, Artificial Sequence; identical to SEQ ID NO: 22146
  neuraminidase__InfluenzaA__AHL98557

SEQ ID NO: 24948 - protein, 469 aa, Artificial Sequence; identical to SEQ ID NO: 22146
  neuraminidase__InfluenzaA__AHL98569

SEQ ID NO: 24949 - protein, 469 aa, Artificial Sequence
  neuraminidase__InfluenzaA__AHL98581
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGNIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24950 - protein, 469 aa, Artificial Sequence; identical to SEQ ID NO: 22146
  neuraminidase__InfluenzaA__AHL98593

SEQ ID NO: 24951 - protein, 469 aa, Artificial Sequence; identical to SEQ ID NO: 23883
  neuraminidase__InfluenzaA__AHL98605

SEQ ID NO: 24952 - protein, 469 aa, Artificial Sequence; identical to SEQ ID NO: 23375
  neuraminidase__InfluenzaA__AHL98617

SEQ ID NO: 24953 - protein, 469 aa, Artificial Sequence; identical to SEQ ID NO: 23375
  neuraminidase__InfluenzaA__AHL98629

SEQ ID NO: 24954 - protein, 469 aa, Artificial Sequence; identical to SEQ ID NO: 22146
  neuraminidase__InfluenzaA__AHL98641

SEQ ID NO: 24955 - protein, 469 aa, Artificial Sequence; identical to SEQ ID NO: 24724
  neuraminidase__InfluenzaA__AHL98653

SEQ ID NO: 24956 - protein, 469 aa, Artificial Sequence; identical to SEQ ID NO: 22146
  neuraminidase__InfluenzaA__AHL98665

SEQ ID NO: 24957 - protein, 469 aa, Artificial Sequence
  neuraminidase__InfluenzaA__AHL98677
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPHRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGNAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24958 - protein, 469 aa, Artificial Sequence; identical to SEQ ID NO: 23894
  neuraminidase__InfluenzaA__AHL98689

SEQ ID NO: 24959 - protein, 469 aa, Artificial Sequence
  neuraminidase__InfluenzaA__AHL98702
MNPNQKIITIGSVSLTISTICFFMQIAILITTVTLHFKQYEFDSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNGHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24960 - protein, 469 aa, Artificial Sequence; identical to SEQ ID NO: 23389
  neuraminidase__InfluenzaA__AHL98714

SEQ ID NO: 24961 - protein, 469 aa, Artificial Sequence
  neuraminidase__InfluenzaA__AHL98725
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGGIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGNASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDENDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 24962 - protein, 469 aa, Artificial Sequence; identical to SEQ ID NO: 23883
  neuraminidase__InfluenzaA__AHL98737

SEQ ID NO: 24963 - protein, 469 aa, Artificial Sequence; identical to SEQ ID NO: 23871
  neuraminidase__InfluenzaA__AHL98749

SEQ ID NO: 24964 - protein, 469 aa, Artificial Sequence; identical to SEQ ID NO: 23883
  neuraminidase__InfluenzaA__AHL98761

SEQ ID NO: 24965 - protein, 469 aa, Artificial Sequence
  neuraminidase__InfluenzaA__AHL98773
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGNIWVTREPYVSCDPDKCYQFALGQGTTLNNVHSNNTARDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24966 - protein, 469 aa, Artificial Sequence; identical to SEQ ID NO: 23903
  neuraminidase__InfluenzaA__AHL98785

SEQ ID NO: 24967 - protein, 469 aa, Artificial Sequence
  neuraminidase__InfluenzaA__AHL98797
MNPNQKIITIGSVSLTISTICFFTQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRSGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24968 - protein, 469 aa, Artificial Sequence; identical to SEQ ID NO: 22146
  neuraminidase__InfluenzaA__AHL98809

SEQ ID NO: 24969 - protein, 469 aa, Artificial Sequence
  neuraminidase__InfluenzaA__AHL98821
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDRCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24970 - protein, 469 aa, Artificial Sequence; identical to SEQ ID NO: 22146
  neuraminidase__InfluenzaA__AHL98833

SEQ ID NO: 24971 - protein, 469 aa, Artificial Sequence
  neuraminidase__InfluenzaA__AHL98845
MNPNQKIITIGSVSLTISTICFFMQIAILITTVTLHFKQYEFNSPPNNQVMLCEPTIIERNITEIVYLINTTIEKEICPKPAEYRNWSKPQCGITGFAPFSKDNSIRLSAGGDIWVTREPYVSCGPDKCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24972 - protein, 469 aa, Artificial Sequence; identical to SEQ ID NO: 23883
  neuraminidase__InfluenzaA__AHL98857

SEQ ID NO: 24973 - protein, 469 aa, Artificial Sequence; identical to SEQ ID NO: 23883
  neuraminidase__InfluenzaA__AHL98869

SEQ ID NO: 24974 - protein, 469 aa, Artificial Sequence; identical to SEQ ID NO: 22146
  neuraminidase__InfluenzaA__AHL98881

SEQ ID NO: 24975 - protein, 469 aa, Artificial Sequence
  neuraminidase__InfluenzaA__AHL98893
MNPNQKIITIGSVSLTISTICFFMQIAILITTVTLHFKQYEFDSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVFEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24976 - protein, 469 aa, Artificial Sequence; identical to SEQ ID NO: 23871
  neuraminidase__InfluenzaA__AHL98905

SEQ ID NO: 24977 - protein, 469 aa, Artificial Sequence; identical to SEQ ID NO: 22146
  neuraminidase__InfluenzaA__AHL98916

SEQ ID NO: 24978 - protein, 469 aa, Artificial Sequence; identical to SEQ ID NO: 23894
  neuraminidase__InfluenzaA__AHL98928

SEQ ID NO: 24979 - protein, 469 aa, Artificial Sequence; identical to SEQ ID NO: 22146
  neuraminidase__InfluenzaA__AHL98940

SEQ ID NO: 24980 - protein, 469 aa, Artificial Sequence; identical to SEQ ID NO: 22146
  neuraminidase__InfluenzaA__AHL98952

SEQ ID NO: 24981 - protein, 469 aa, Artificial Sequence; identical to SEQ ID NO: 23871
  neuraminidase__InfluenzaA__AHL98964

SEQ ID NO: 24982 - protein, 469 aa, Artificial Sequence
  neuraminidase__InfluenzaA__AHL98976
MNPNQKIITIGSVSLTISTICFFMQIAILITTVTLHFKQYEFNSPPNNQVMLCEPTIVERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVASWSKEVLRTQESECVCINGTCAVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24983 - protein, 469 aa, Artificial Sequence; identical to SEQ ID NO: 23871
  neuraminidase__InfluenzaA__AHL98988

SEQ ID NO: 24984 - protein, 469 aa, Artificial Sequence; identical to SEQ ID NO: 22146
  neuraminidase__InfluenzaA__AHL99000

SEQ ID NO: 24985 - protein, 469 aa, Artificial Sequence; identical to SEQ ID NO: 22146
  neuraminidase__InfluenzaA__AHL99012

SEQ ID NO: 24986 - protein, 469 aa, Artificial Sequence
  neuraminidase__InfluenzaA__AHL99024
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCICRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24987 - protein, 469 aa, Artificial Sequence; identical to SEQ ID NO: 23364
  neuraminidase__InfluenzaA__AHL99036

SEQ ID NO: 24988 - protein, 469 aa, Artificial Sequence; identical to SEQ ID NO: 24786
  neuraminidase__InfluenzaA__AHL99048

SEQ ID NO: 24989 - protein, 469 aa, Artificial Sequence; identical to SEQ ID NO: 22146
  neuraminidase__InfluenzaA__AHL99060

SEQ ID NO: 24990 - protein, 469 aa, Artificial Sequence
  neuraminidase__InfluenzaA__AHL99072
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINMKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24991 - protein, 469 aa, Artificial Sequence
  neuraminidase__InfluenzaA__AHL99084
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDRCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHNIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24992 - protein, 469 aa, Artificial Sequence; identical to SEQ ID NO: 22146
  neuraminidase__InfluenzaA__AHL99096

SEQ ID NO: 24993 - protein, 469 aa, Artificial Sequence; identical to SEQ ID NO: 22146
  neuraminidase__InfluenzaA__AHL99108

SEQ ID NO: 24994 - protein, 469 aa, Artificial Sequence; identical to SEQ ID NO: 22146
  neuraminidase__InfluenzaA__AHL99120

SEQ ID NO: 24995 - protein, 469 aa, Artificial Sequence; identical to SEQ ID NO: 22146
  neuraminidase__InfluenzaA__AHL99132

SEQ ID NO: 24996 - protein, 469 aa, Artificial Sequence
  neuraminidase__InfluenzaA__AHL99144
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGRIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24997 - protein, 469 aa, Artificial Sequence; identical to SEQ ID NO: 22146
  neuraminidase__InfluenzaA__AHL99156

SEQ ID NO: 24998 - protein, 469 aa, Artificial Sequence
  neuraminidase__InfluenzaA__AHL99168
MNPNQKIITIGSVSLTISTICFFMQIAILITTVTLHFKQYEFNSPPNNQVMLCEPTIIERNTTEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 24999 - protein, 469 aa, Artificial Sequence; identical to SEQ ID NO: 22146
  neuraminidase__InfluenzaA__AHL99180

SEQ ID NO: 25000 - protein, 469 aa, Artificial Sequence; identical to SEQ ID NO: 23010
  neuraminidase__InfluenzaA__AHL99204

SEQ ID NO: 25001 - protein, 469 aa, Artificial Sequence
  neuraminidase__InfluenzaA__AHL99216
MNPNQKIITIGSVSLTISTICFFMQIAILITTVTLHFKQYEFNSPPNNQVMLCEPTIIERNITEIVYLTNTTVEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIIDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKKETEVLWTSNSIVVFCGTSGTYGTGSWPDGADLNLMPI

SEQ ID NO: 25002 - protein, 469 aa, Artificial Sequence; identical to SEQ ID NO: 22146
  neuraminidase__InfluenzaA__AHL99228

SEQ ID NO: 25003 - protein, 469 aa, Artificial Sequence; identical to SEQ ID NO: 22146
  neuraminidase__InfluenzaA__AHL99240

SEQ ID NO: 25004 - protein, 469 aa, Artificial Sequence; identical to SEQ ID NO: 22146
  neuraminidase__InfluenzaA__AHL99252

SEQ ID NO: 25005 - protein, 469 aa, Artificial Sequence; identical to SEQ ID NO: 22146
  neuraminidase__InfluenzaA__AHL99264

SEQ ID NO: 25006 - protein, 469 aa, Artificial Sequence; identical to SEQ ID NO: 22146
  neuraminidase__InfluenzaA__AHL99276

SEQ ID NO: 25007 - protein, 469 aa, Artificial Sequence; identical to SEQ ID NO: 23883
  neuraminidase__InfluenzaA__AHL99288

SEQ ID NO: 25008 - protein, 469 aa, Artificial Sequence; identical to SEQ ID NO: 24786
  neuraminidase__InfluenzaA__AHL99300

SEQ ID NO: 25009 - protein, 469 aa, Artificial Sequence; identical to SEQ ID NO: 22146
  neuraminidase__InfluenzaA__AHL99312

SEQ ID NO: 25010 - protein, 469 aa, Artificial Sequence
  neuraminidase__InfluenzaA__AHL99324
MNPNQKIITIGSVSLTISTICFFMQIAILITTVTLHFKQYEFNSPPNNQVILCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25011 - protein, 469 aa, Artificial Sequence; identical to SEQ ID NO: 23389
  neuraminidase__InfluenzaA__AHL99348

SEQ ID NO: 25012 - protein, 469 aa, Artificial Sequence; identical to SEQ ID NO: 23389
  neuraminidase__InfluenzaA__AHL99359

SEQ ID NO: 25013 - protein, 469 aa, Artificial Sequence
  neuraminidase__InfluenzaA__AHL99370
MNPNQKIITIGSVSLTITTICFFMQIAILITTVTLHFKQYEFNSPPNNQMMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25014 - protein, 469 aa, Artificial Sequence; identical to SEQ ID NO: 22146
  neuraminidase__InfluenzaA__AHL99393

SEQ ID NO: 25015 - protein, 469 aa, Artificial Sequence; identical to SEQ ID NO: 22146
  neuraminidase__InfluenzaA__AHL99417

SEQ ID NO: 25016 - protein, 469 aa, Artificial Sequence; identical to SEQ ID NO: 22146
  neuraminidase__InfluenzaA__AHL99429

SEQ ID NO: 25017 - protein, 469 aa, Artificial Sequence; identical to SEQ ID NO: 22146
  neuraminidase__InfluenzaA__AHL99441

SEQ ID NO: 25018 - protein, 469 aa, Artificial Sequence; identical to SEQ ID NO: 22146
  neuraminidase__InfluenzaA__AHL99453

SEQ ID NO: 25019 - protein, 469 aa, Artificial Sequence; identical to SEQ ID NO: 22146
  neuraminidase__InfluenzaA__AHL99477

SEQ ID NO: 25020 - protein, 469 aa, Artificial Sequence; identical to SEQ ID NO: 24786
  neuraminidase__InfluenzaA__AHL99489

SEQ ID NO: 25021 - protein, 469 aa, Artificial Sequence
  neuraminidase__InfluenzaA__AHL99501
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSTVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25022 - protein, 469 aa, Artificial Sequence; identical to SEQ ID NO: 22146
  neuraminidase__InfluenzaA__AHL99525

SEQ ID NO: 25023 - protein, 469 aa, Artificial Sequence
  neuraminidase__InfluenzaA__AHL99537
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTSYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25024 - protein, 469 aa, Artificial Sequence; identical to SEQ ID NO: 23883
  neuraminidase__InfluenzaA__AHL99549

SEQ ID NO: 25025 - protein, 469 aa, Artificial Sequence; identical to SEQ ID NO: 22146
  neuraminidase__InfluenzaA__AHL99561

SEQ ID NO: 25026 - protein, 469 aa, Artificial Sequence
  neuraminidase__InfluenzaA__AHL99573
MNPNQKIITIGSVSLTISTICFFMQIAILITTVTLHFKQYEFNSPPNNQVMLCEPTIIERNITEIVYLTNTTGEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIIDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDKGDRSGYSGIFSVEGKSCINRCFYVELIRGRKEETEVLWTSNSIVVFCGTSGTYGTGSWPDGADLNLMPI

SEQ ID NO: 25027 - protein, 469 aa, Artificial Sequence
  neuraminidase__InfluenzaA__AHL99585
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTARDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLNPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25028 - protein, 469 aa, Artificial Sequence
  neuraminidase__InfluenzaA__AHL99597
MNPNQKIITIGSVCMTIGMANLILQIGNIISIWISHSIQVGNQSQIETCNQSVITYENNTWVNQTYVNISNTNFAVGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNDILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25029 - protein, 469 aa, Artificial Sequence
  neuraminidase__InfluenzaA__AHL99608
MNPNQKIITIGSVSLTISTICVFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25030 - protein, 469 aa, Artificial Sequence
  neuraminidase__InfluenzaA__AHL99620
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25031 - protein, 469 aa, Artificial Sequence
  neuraminidase__InfluenzaA__AHL99632
MNPNQKIITIGSVSLTISTICFFMQIAILITTVTLHFKQYEFNSPPNNQVMLCEPTTIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25032 - protein, 469 aa, Artificial Sequence; identical to SEQ ID NO: 24821
  neuraminidase__InfluenzaA__AHL99644

SEQ ID NO: 25033 - protein, 469 aa, Artificial Sequence
  neuraminidase__InfluenzaA__AHL99668
MNPNQKIITIGSVSLTISTICFFMQIAILITTVTLHFKQYEFNSPPNNQVMLCEPTIIERNITEIVYLTNTTVEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIIDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25034 - protein, 469 aa, Artificial Sequence; identical to SEQ ID NO: 22146
  neuraminidase__InfluenzaA__AHL99680

SEQ ID NO: 25035 - protein, 469 aa, Artificial Sequence
  neuraminidase__InfluenzaA__AHL99692
MNPNQKIITIGSVSLTISTTCFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25036 - protein, 469 aa, Artificial Sequence; identical to SEQ ID NO: 22146
  neuraminidase__InfluenzaA__AHL99704

SEQ ID NO: 25037 - protein, 469 aa, Artificial Sequence; identical to SEQ ID NO: 22146
  neuraminidase__InfluenzaA__AHL99716

SEQ ID NO: 25038 - protein, 469 aa, Artificial Sequence; identical to SEQ ID NO: 25028
  neuraminidase__InfluenzaA__AHL99740

SEQ ID NO: 25039 - protein, 469 aa, Artificial Sequence
  neuraminidase__InfluenzaA__AHL99751
MNPNQKIITIGSVSLTISTICFFMQIAILITTVTLHFKQYEFNSPPNNQVMLCEPTIIERNITEIVYLTNTTVEKEICPKPAEYRNWSKPQCGITGFAPFSKDNSIRLSAGGDIWVTREPYVSCDPDKCYQFALGQGTTLNNVHSNNTARDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLNPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25040 - protein, 469 aa, Artificial Sequence
  neuraminidase__InfluenzaA__AHL99763
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQMNRQVIVDRGDRSGYSGIFSVEGKSCINRCFYVELIRGRKEETEVLWTSNSIVVFCGTSGTYGTGSWPDGADLNLMPI

SEQ ID NO: 25041 - protein, 469 aa, Artificial Sequence; identical to SEQ ID NO: 22146
  neuraminidase__InfluenzaA__AHL99775

SEQ ID NO: 25042 - protein, 469 aa, Artificial Sequence
  neuraminidase__InfluenzaA__AHL99787
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPESKLQINRQVIVDRGDRSGYSGIFSVEGKSCINRCFYVELIRGRKEETEVLWTSNSIVVFCGTSGTYGTGSWPDGADLNLMPI

SEQ ID NO: 25043 - protein, 469 aa, Artificial Sequence
  neuraminidase__InfluenzaA__AHL99799
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCICRDNWKGSNRPIVDINIKDHSIVSSYVCSGLVGDTPRKNDSSSSSHCLGPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25044 - protein, 469 aa, Artificial Sequence; identical to SEQ ID NO: 22146
  neuraminidase__InfluenzaA__AHL99811

SEQ ID NO: 25045 - protein, 469 aa, Artificial Sequence
  neuraminidase__InfluenzaA__AHL99823
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCAVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25046 - protein, 469 aa, Artificial Sequence
  neuraminidase__InfluenzaA__AHL99835
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCAPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLLINRQVIVDRGDRSGYSGIFSVEGKSCINRCFYVELIRGRKEETEVLWTSNSIVVFCGTSGTYGTGSWPDGADLNLMPI

SEQ ID NO: 25047 - protein, 469 aa, Artificial Sequence; identical to SEQ ID NO: 22146
  neuraminidase__InfluenzaA__AHL99847

SEQ ID NO: 25048 - protein, 469 aa, Artificial Sequence; identical to SEQ ID NO: 23375
  neuraminidase__InfluenzaA__AHL99859

SEQ ID NO: 25049 - protein, 469 aa, Artificial Sequence
  neuraminidase__InfluenzaA__AHL99871
MNPNQKIITIGSVSLTISTICFFMQIAILTTTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGRIVHTSTLSGSAQHVEECSCYPRYPGVRCVCRDNWKGSNRPIVDINIKDHSIVSRYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25050 - protein, 469 aa, Artificial Sequence; identical to SEQ ID NO: 22146
  neuraminidase__InfluenzaA__AHL99883

SEQ ID NO: 25051 - protein, 469 aa, Artificial Sequence; identical to SEQ ID NO: 25027
  neuraminidase__InfluenzaA__AHL99895

SEQ ID NO: 25052 - protein, 469 aa, Artificial Sequence; identical to SEQ ID NO: 22146
  neuraminidase__InfluenzaA__AHL99907

SEQ ID NO: 25053 - protein, 469 aa, Artificial Sequence; identical to SEQ ID NO: 22146
  neuraminidase__InfluenzaA__AHL99919

SEQ ID NO: 25054 - protein, 469 aa, Artificial Sequence
  neuraminidase__InfluenzaA__AHL99943
MNPNQKIITIGSVSLTISTICFFMQIAILITTVTLHFKQHEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25055 - protein, 469 aa, Artificial Sequence; identical to SEQ ID NO: 22146
  neuraminidase__InfluenzaA__AHL99955

SEQ ID NO: 25056 - protein, 469 aa, Artificial Sequence
  neuraminidase__InfluenzaA__AHL99967
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVHDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINMKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25057 - protein, 469 aa, Artificial Sequence
  neuraminidase__InfluenzaA__AHL99979
MNPNQKIITIGSVSLTISTICFFMQIAILITTVALHFKQHEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25058 - protein, 469 aa, Artificial Sequence; identical to SEQ ID NO: 25054
  neuraminidase__InfluenzaA__AHL99991

SEQ ID NO: 25059 - protein, 469 aa, Artificial Sequence; identical to SEQ ID NO: 22146
  neuraminidase__InfluenzaA__AHM00004

SEQ ID NO: 25060 - protein, 469 aa, Artificial Sequence; identical to SEQ ID NO: 22146
  neuraminidase__InfluenzaA__AHM00016

SEQ ID NO: 25061 - protein, 469 aa, Artificial Sequence; identical to SEQ ID NO: 22146
  neuraminidase__InfluenzaA__AHM00028

SEQ ID NO: 25062 - protein, 469 aa, Artificial Sequence; identical to SEQ ID NO: 25054
  neuraminidase__InfluenzaA__AHM00040

SEQ ID NO: 25063 - protein, 469 aa, Artificial Sequence; identical to SEQ ID NO: 22146
  neuraminidase__InfluenzaA__AHM00052

SEQ ID NO: 25064 - protein, 469 aa, Artificial Sequence; identical to SEQ ID NO: 23010
  neuraminidase__InfluenzaA__AHM00064

SEQ ID NO: 25065 - protein, 469 aa, Artificial Sequence; identical to SEQ ID NO: 22146
  neuraminidase__InfluenzaA__AHM00076

SEQ ID NO: 25066 - protein, 469 aa, Artificial Sequence; identical to SEQ ID NO: 22146
  neuraminidase__InfluenzaA__AHM00088

SEQ ID NO: 25067 - protein, 469 aa, Artificial Sequence
  neuraminidase__InfluenzaA__AHM00100
MNPNQKIITIGSICMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGVITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSTKQDIVGINEWSGYSGSFVQHPELTGLDCIRPCFWVELIRGRPKENTIWTSGSSISFCGVNSDTVGWSWPDGAELPFTIDN

SEQ ID NO: 25068 - protein, 469 aa, Artificial Sequence; identical to SEQ ID NO: 24990
  neuraminidase__InfluenzaA__AHM00111

SEQ ID NO: 25069 - protein, 469 aa, Artificial Sequence; identical to SEQ ID NO: 25054
  neuraminidase__InfluenzaA__AHM00123

SEQ ID NO: 25070 - protein, 469 aa, Artificial Sequence; identical to SEQ ID NO: 23375
  neuraminidase__InfluenzaA__AHM00135

SEQ ID NO: 25071 - protein, 469 aa, Artificial Sequence; identical to SEQ ID NO: 23883
  neuraminidase__InfluenzaA__AHM00147

SEQ ID NO: 25072 - protein, 469 aa, Artificial Sequence; identical to SEQ ID NO: 25054
  neuraminidase__InfluenzaA__AHM00159

SEQ ID NO: 25073 - protein, 469 aa, Artificial Sequence; identical to SEQ ID NO: 22146
  neuraminidase__InfluenzaA__AHM00171

SEQ ID NO: 25074 - protein, 469 aa, Artificial Sequence; identical to SEQ ID NO: 22146
  neuraminidase__InfluenzaA__AHM00183

SEQ ID NO: 25075 - protein, 469 aa, Artificial Sequence
  neuraminidase__InfluenzaA__AHM00195
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKVLFIEEGKIVHTSTLSGSAQHVEECSCYPRYPGVRCVCRDNWKGSNRPIVDINIKDHSIVSRYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25076 - protein, 469 aa, Artificial Sequence
  neuraminidase__InfluenzaA__AHM00207
MNPNQKIITIGSVSLTISTICFFMQIAILITTVTLHFKQHEFNSPPNNQVMLCEPTIIERNITEIVYLTNTTIEKEICPKPAEYRNWSKPQCGITGFAPFSKDNSIRLSAGGNIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25077 - protein, 469 aa, Artificial Sequence; identical to SEQ ID NO: 25054
  neuraminidase__InfluenzaA__AHM00219

SEQ ID NO: 25078 - protein, 469 aa, Artificial Sequence; identical to SEQ ID NO: 22146
  neuraminidase__InfluenzaA__AHM00231

SEQ ID NO: 25079 - protein, 469 aa, Artificial Sequence; identical to SEQ ID NO: 22146
  neuraminidase__InfluenzaA__AHM00243

SEQ ID NO: 25080 - protein, 469 aa, Artificial Sequence; identical to SEQ ID NO: 22146
  neuraminidase__InfluenzaA__AHM00255

SEQ ID NO: 25081 - protein, 469 aa, Artificial Sequence
  neuraminidase__InfluenzaA__AHM00267
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVASWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25082 - protein, 469 aa, Artificial Sequence; identical to SEQ ID NO: 23375
  neuraminidase__InfluenzaA__AHM00279

SEQ ID NO: 25083 - protein, 469 aa, Artificial Sequence; identical to SEQ ID NO: 22146
  neuraminidase__InfluenzaA__AHM00291

SEQ ID NO: 25084 - protein, 469 aa, Artificial Sequence; identical to SEQ ID NO: 22146
  neuraminidase__InfluenzaA__AHM00303

SEQ ID NO: 25085 - protein, 469 aa, Artificial Sequence; identical to SEQ ID NO: 22146
  neuraminidase__InfluenzaA__AHM00315

SEQ ID NO: 25086 - protein, 469 aa, Artificial Sequence; identical to SEQ ID NO: 23375
  neuraminidase__InfluenzaA__AHM00327

SEQ ID NO: 25087 - protein, 469 aa, Artificial Sequence; identical to SEQ ID NO: 23375
  neuraminidase__InfluenzaA__AHM00339

SEQ ID NO: 25088 - protein, 469 aa, Artificial Sequence; identical to SEQ ID NO: 25054
  neuraminidase__InfluenzaA__AHM00351

SEQ ID NO: 25089 - protein, 469 aa, Artificial Sequence; identical to SEQ ID NO: 24990
  neuraminidase__InfluenzaA__AHM00363

SEQ ID NO: 25090 - protein, 469 aa, Artificial Sequence
  neuraminidase__InfluenzaA__AHM00375
MNPNQKIITIGSVSLTISTICFFMQIAILITTVTLHFKQHEFNSPPNNQVMLCEPTIIERNITEIVYLTNTTIEKEVCPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25091 - protein, 469 aa, Artificial Sequence
  neuraminidase__InfluenzaA__AHM00398
MNPNQKIITIGSVSLTISTICFFMQIAILITTVTLHFKQHEFNSPPNNQVMLCEPTIIERNITEIVYLTNTTIEKEICPKPAEYRNWSKPQCGITGFAPFSKENSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSSSIVVFCGTSGTYGTGSWPDGADLNLMPI

SEQ ID NO: 25092 - protein, 469 aa, Artificial Sequence; identical to SEQ ID NO: 22146
  neuraminidase__InfluenzaA__AHM00410

SEQ ID NO: 25093 - protein, 469 aa, Artificial Sequence
  neuraminidase__InfluenzaA__AHM00422
MNPNQKIITIGSVSLTISTICFFMQIAILVTTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25094 - protein, 469 aa, Artificial Sequence
  neuraminidase__InfluenzaA__AHM00434
MNPNQKIITIGSVSLTISTICFFMQIAILITTVTLHFKQYEFNPPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25095 - protein, 469 aa, Artificial Sequence; identical to SEQ ID NO: 22146
  neuraminidase__InfluenzaA__AHM00446

SEQ ID NO: 25096 - protein, 469 aa, Artificial Sequence; identical to SEQ ID NO: 25054
  neuraminidase__InfluenzaA__AHM00458

SEQ ID NO: 25097 - protein, 469 aa, Artificial Sequence; identical to SEQ ID NO: 25054
  neuraminidase__InfluenzaA__AHM00470

SEQ ID NO: 25098 - protein, 469 aa, Artificial Sequence; identical to SEQ ID NO: 25054
  neuraminidase__InfluenzaA__AHM00482

SEQ ID NO: 25099 - protein, 469 aa, Artificial Sequence; identical to SEQ ID NO: 25054
  neuraminidase__InfluenzaA__AHM00494

SEQ ID NO: 25100 - protein, 469 aa, Artificial Sequence
  neuraminidase__InfluenzaA__AHM00506
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVNRGDRSGYSGIFSVEGKSCINRCFYVELIRGRKEETEVLWTSNSIVVFCGTSGTYGTGSWPDGADLNLMPI

SEQ ID NO: 25101 - protein, 469 aa, Artificial Sequence; identical to SEQ ID NO: 22146
  neuraminidase__InfluenzaA__AHM00518

SEQ ID NO: 25102 - protein, 469 aa, Artificial Sequence
  neuraminidase__InfluenzaA__AHM00530
MNPNQKIITIGSVSLTISTICFSMQIAILITTVTLHFKQYEFNPPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25103 - protein, 469 aa, Artificial Sequence; identical to SEQ ID NO: 23375
  neuraminidase__InfluenzaA__AHM00542

SEQ ID NO: 25104 - protein, 469 aa, Artificial Sequence
  neuraminidase__InfluenzaA__AHM00546
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSKYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25105 - protein, 469 aa, Artificial Sequence
  neuraminidase__InfluenzaA__AHM00558
MNPNQKIITIGSVSLTISTICFFMQIAILITTVTLHFKQYEFNSPPNNQVMLCEPTIIERNITEIVYLTNTTIEKEVCPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25106 - protein, 469 aa, Artificial Sequence; identical to SEQ ID NO: 22146
  neuraminidase__InfluenzaA__AHM00570

SEQ ID NO: 25107 - protein, 469 aa, Artificial Sequence; identical to SEQ ID NO: 22146
  neuraminidase__InfluenzaA__AHM00582

SEQ ID NO: 25108 - protein, 469 aa, Artificial Sequence
  neuraminidase__InfluenzaA__AHM00594
MNPNQKIITIGSVSLTISTICFFMQIAILITTVTLHFKQHEFNSPPNNQVMLCEPTIIERNITEIVHLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25109 - protein, 469 aa, Artificial Sequence; identical to SEQ ID NO: 22146
  neuraminidase__InfluenzaA__AHM00606

SEQ ID NO: 25110 - protein, 469 aa, Artificial Sequence; identical to SEQ ID NO: 22146
  neuraminidase__InfluenzaA__AHM00618

SEQ ID NO: 25111 - protein, 469 aa, Artificial Sequence; identical to SEQ ID NO: 22146
  neuraminidase__InfluenzaA__AHM00630

SEQ ID NO: 25112 - protein, 469 aa, Artificial Sequence; identical to SEQ ID NO: 22146
  neuraminidase__InfluenzaA__AHM00642

SEQ ID NO: 25113 - protein, 469 aa, Artificial Sequence; identical to SEQ ID NO: 23375
  neuraminidase__InfluenzaA__AHM00654

SEQ ID NO: 25114 - protein, 469 aa, Artificial Sequence; identical to SEQ ID NO: 22146
  neuraminidase__InfluenzaA__AHM00666

SEQ ID NO: 25115 - protein, 469 aa, Artificial Sequence; identical to SEQ ID NO: 25054
  neuraminidase__InfluenzaA__AHM00678

SEQ ID NO: 25116 - protein, 469 aa, Artificial Sequence; identical to SEQ ID NO: 23389
  neuraminidase__InfluenzaA__AHM00690

SEQ ID NO: 25117 - protein, 469 aa, Artificial Sequence; identical to SEQ ID NO: 23375
  neuraminidase__InfluenzaA__AHM00701

SEQ ID NO: 25118 - protein, 469 aa, Artificial Sequence
  neuraminidase__InfluenzaA__AHM00713
MNPNQKIITIGSVSLTISTICFFMQIAILITTVTLHFKQYEFNSPPNNQVMLCEPTIIERNITEIVYLTNTTIEKEICPKSAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25119 - protein, 469 aa, Artificial Sequence; identical to SEQ ID NO: 22146
  neuraminidase__InfluenzaA__AHM00725

SEQ ID NO: 25120 - protein, 469 aa, Artificial Sequence; identical to SEQ ID NO: 22146
  neuraminidase__InfluenzaA__AHM00737

SEQ ID NO: 25121 - protein, 469 aa, Artificial Sequence; identical to SEQ ID NO: 25054
  neuraminidase__InfluenzaA__AHM00749

SEQ ID NO: 25122 - protein, 469 aa, Artificial Sequence; identical to SEQ ID NO: 22146
  neuraminidase__InfluenzaA__AHM00761

SEQ ID NO: 25123 - protein, 469 aa, Artificial Sequence; identical to SEQ ID NO: 23375
  neuraminidase__InfluenzaA__AHM00785

SEQ ID NO: 25124 - protein, 469 aa, Artificial Sequence; identical to SEQ ID NO: 23010
  neuraminidase__InfluenzaA__AHM00797

SEQ ID NO: 25125 - protein, 469 aa, Artificial Sequence
  neuraminidase__InfluenzaA__AHM00809
MNPNQKIITIGSVSLTISTICFFIQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25126 - protein, 469 aa, Artificial Sequence; identical to SEQ ID NO: 25054
  neuraminidase__InfluenzaA__AHM00821

SEQ ID NO: 25127 - protein, 469 aa, Artificial Sequence; identical to SEQ ID NO: 25054
  neuraminidase__InfluenzaA__AHM00833

SEQ ID NO: 25128 - protein, 469 aa, Artificial Sequence; identical to SEQ ID NO: 23010
  neuraminidase__InfluenzaA__AHM00845

SEQ ID NO: 25129 - protein, 469 aa, Artificial Sequence; identical to SEQ ID NO: 22146
  neuraminidase__InfluenzaA__AHM00857

SEQ ID NO: 25130 - protein, 469 aa, Artificial Sequence; identical to SEQ ID NO: 22146
  neuraminidase__InfluenzaA__AHM00869

SEQ ID NO: 25131 - protein, 469 aa, Artificial Sequence; identical to SEQ ID NO: 22146
  neuraminidase__InfluenzaA__AHM00881

SEQ ID NO: 25132 - protein, 469 aa, Artificial Sequence; identical to SEQ ID NO: 23375
  neuraminidase__InfluenzaA__AHM00893

SEQ ID NO: 25133 - protein, 469 aa, Artificial Sequence
  neuraminidase__InfluenzaA__AHM00905
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKTDSSSSGHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25134 - protein, 469 aa, Artificial Sequence
  neuraminidase__InfluenzaA__AHM00917
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDIWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25135 - protein, 469 aa, Artificial Sequence; identical to SEQ ID NO: 22146
  neuraminidase__InfluenzaA__AHM00929

SEQ ID NO: 25136 - protein, 469 aa, Artificial Sequence
  neuraminidase__InfluenzaA__AHM00941
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTIRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSRYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25137 - protein, 469 aa, Artificial Sequence
  neuraminidase__InfluenzaA__AHM00953
MNPNQKIITIGSVSLTISTICFFMQIAILITTVTLHFKQYAFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25138 - protein, 469 aa, Artificial Sequence; identical to SEQ ID NO: 23375
  neuraminidase__InfluenzaA__AHM00965

SEQ ID NO: 25139 - protein, 469 aa, Artificial Sequence; identical to SEQ ID NO: 23375
  neuraminidase__InfluenzaA__AHM00977

SEQ ID NO: 25140 - protein, 465 aa, Artificial Sequence
  neuraminidase__InfluenzaA__AHM24226
MNPNQKILCTSATAIIIGAIAVLIGIANLGLNIGLHLKPGCNCSHSQPETTNTSQTIINNYYNETNITNIQMEERTSRNFNNLTKGLCTINSWHIYGKDNAVRIGESSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKMLKWESLTGTAKHNEECSCYGERTGITCTCRDNWQGSNRPVIQIDPVAMTHTSQYICSPVLTDNPRPNDPNIGKCNDPYPGNNNNGVKGFSYLDGANTWLGRTISTASRSGYEMLKVPNALTDDRSKPIQGQTIVLNADWSGYSGSFMDYWAEGDCYRACFYVELIRGRPKEDKVWWTSNSIVSMCSSTEFLGQWNWPDGAKIEYFL

SEQ ID NO: 25141 - protein, 465 aa, Artificial Sequence; identical to SEQ ID NO: 23454
  neuraminidase__InfluenzaA__AHM24238

SEQ ID NO: 25142 - protein, 465 aa, Artificial Sequence
  neuraminidase__InfluenzaA__AHM24250
MNPNQKILCTSATAIIIGAIAVLIGIANLGLNIGLHLKPSCNCSHSQPETTNTSQTIINNYYNETNITNIQMEERTSRNFNNLTKGLCTINSWHIYGKDNAVRIGENSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKILKWESLTGTAKHIEECSCYGERTGITCTCRDNWQGSNRPVIQIDPVAMTHTSQYICSPVLTDNPRPNDPNIGKCNDPYPGNNNNGVKGFSYLDGANTWLGRTISTASRSGYEMLKVPNALTDDRSKPIQGQTIVLNADWSGYSGSFMDYWAEGDCYRACFYVELIRGRPKEDKVWWTSNSIVSMCSSTEFLGQWNWPDGAKIEYFL

SEQ ID NO: 25143 - protein, 469 aa, Artificial Sequence; identical to SEQ ID NO: 20709
  neuraminidase__InfluenzaA__AHM98312

SEQ ID NO: 25144 - protein, 469 aa, Artificial Sequence
  neuraminidase__InfluenzaA__AHM98331
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVHSDTVGWSWPDGAELPFTIDK

SEQ ID NO: 25145 - protein, 469 aa, Artificial Sequence; identical to SEQ ID NO: 20725
  neuraminidase__InfluenzaA__AHM98342

SEQ ID NO: 25146 - protein, 469 aa, Artificial Sequence
  neuraminidase__InfluenzaA__AHM98353
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVDGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25147 - protein, 469 aa, Artificial Sequence
  neuraminidase__InfluenzaA__AHM98364
MNPNQKIITIGSVCMTIGMANLILQIGNIISIWISHSIQLGNQSQIETCNQSVITYENNTWVNQTYVNISNTNFAAGQSVVSVNLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25148 - protein, 469 aa, Artificial Sequence
  neuraminidase__InfluenzaA__AHM98375
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPFRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25149 - protein, 469 aa, Artificial Sequence; identical to SEQ ID NO: 20709
  neuraminidase__InfluenzaA__AHM98386

SEQ ID NO: 25150 - protein, 469 aa, Artificial Sequence
  neuraminidase__InfluenzaA__AHM98408
MNPNQKIITIGSVCMTIGMANLILQIGNIISIWISHSIQLGNQSQIETCNQSVITYENNTWINQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNSFSIKQDIVGINEWSGYSGSFVQHPELTGLDCIRPCFWVELIRGRPKENTIWTSGSSISFCGVNSDTVGWSWPDGAELPFTIDK

SEQ ID NO: 25151 - protein, 469 aa, Artificial Sequence; identical to SEQ ID NO: 25150
  neuraminidase__InfluenzaA__AHM98419

SEQ ID NO: 25152 - protein, 469 aa, Artificial Sequence
  neuraminidase__InfluenzaA__AHM98430
MNPNQKIITIGSVCMTIGMANLILQIGNIISIWISHSIQLGNQSQIETCNQNVITYENNTWVNQTYVNISNTNFAAGQSVVPVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25153 - protein, 469 aa, Artificial Sequence; identical to SEQ ID NO: 20957
  neuraminidase__InfluenzaA__AHM98441

SEQ ID NO: 25154 - protein, 469 aa, Artificial Sequence
  neuraminidase__InfluenzaA__AHM98452
MNPNQKIITIGSVCMTIGMANLILQIGNIISIWISHSIQLRNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGVNEWSGYSGSFVQHPELTGLDCIRPCFWVELIRGRPKENTIWTSGSSISFCGVNSDTVGWSWPDGAELPFTIDK

SEQ ID NO: 25155 - protein, 469 aa, Artificial Sequence; identical to SEQ ID NO: 20709
  neuraminidase__InfluenzaA__AHM98474

SEQ ID NO: 25156 - protein, 469 aa, Artificial Sequence
  neuraminidase__InfluenzaA__AHM98485
MNPNQKIITIGSVCMTIGMANLILQIGNIISIWISHSIQLGNQSQIETCNQSVITYENNTWVNQTYVNISNTNFAAGQSVVSVKLVGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25157 - protein, 469 aa, Artificial Sequence
  neuraminidase__InfluenzaA__AHM98496
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKNRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEIKCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25158 - protein, 469 aa, Artificial Sequence; identical to SEQ ID NO: 20709
  neuraminidase__InfluenzaA__AHM98507

SEQ ID NO: 25159 - protein, 469 aa, Artificial Sequence
  neuraminidase__InfluenzaA__AHM98518
MNPNQKIITIGSVCMTIGMANLILQIGNIISIWISHSIQLGNQSQIETCNQSVITYENNTWINQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSMSFCGVNSDTVGWSWPDGAELPFTIDK

SEQ ID NO: 25160 - protein, 469 aa, Artificial Sequence; identical to SEQ ID NO: 20257
  neuraminidase__InfluenzaA__AHM98529

SEQ ID NO: 25161 - protein, 469 aa, Artificial Sequence; identical to SEQ ID NO: 21001
  neuraminidase__InfluenzaA__AHM98540

SEQ ID NO: 25162 - protein, 469 aa, Artificial Sequence
  neuraminidase__InfluenzaA__AHM98562
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKAGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSYTVGWSWPDGAELPFTIDK

SEQ ID NO: 25163 - protein, 469 aa, Artificial Sequence; identical to SEQ ID NO: 25152
  neuraminidase__InfluenzaA__AHM98573

SEQ ID NO: 25164 - protein, 469 aa, Artificial Sequence
  neuraminidase__InfluenzaA__AHM98584
MNPNQKIITIGSVCMTIGMANLILQIGNIISIWISHSIQLGNQSQIETCNQSVITYENNTWINQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLRYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNSFSIKQDIVGINEWSGYSGSFVQHPELTGLDCIRPCFWVELIRGRPKENTIWTSGSSISFCGVNSDTVGWSWPDGAELPFTIDK

SEQ ID NO: 25165 - protein, 469 aa, Artificial Sequence; identical to SEQ ID NO: 25152
  neuraminidase__InfluenzaA__AHM98595

SEQ ID NO: 25166 - protein, 469 aa, Artificial Sequence; identical to SEQ ID NO: 20709
  neuraminidase__InfluenzaA__AHM98606

SEQ ID NO: 25167 - protein, 469 aa, Artificial Sequence
  neuraminidase__InfluenzaA__AHM98617
MNPNQKIITIGSVCMTIGMANLILQIGNIISIWISHSIQLGNQSQIETCNQSVITYENNTWINQTYVNISNTNFAAGQSVVSVKLAGNSSLCPVSGWAIYSKDNSIRIGSKGDVFVIREPFISCSPLGCRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNSFSIKQDIVGINEWSGYSGSFVQHPELTGLDCIRPCFWVELIRGRPKENTIWTSGSSISFCGVNSDTVGWSWPDGAELPFTIDK

SEQ ID NO: 25168 - protein, 469 aa, Artificial Sequence; identical to SEQ ID NO: 25150
  neuraminidase__InfluenzaA__AHM98628

SEQ ID NO: 25169 - protein, 469 aa, Artificial Sequence
  neuraminidase__InfluenzaA__AHM98639
MNPNQKIITIGSVCMTIGMANLILQIGNIISIWISHSIQLGNQSQIETCNQSVIIYENNTWINQTYVNISNTNFAAEQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNSFSIKQDIVGINEWSGYSGSFVQHPELTGLDCIRPCFWVELIRGRPKENTIWTSGSSISFCGVNSDTVGWSWPDGAELPFTIDK

SEQ ID NO: 25170 - protein, 469 aa, Artificial Sequence; identical to SEQ ID NO: 20709
  neuraminidase__InfluenzaA__AHM98650

SEQ ID NO: 25171 - protein, 469 aa, Artificial Sequence; identical to SEQ ID NO: 20709
  neuraminidase__InfluenzaA__AHM98661

SEQ ID NO: 25172 - protein, 469 aa, Artificial Sequence
  neuraminidase__InfluenzaA__AHM98672
MNPNQKIITIGSVCMTIGMANLILQIGNIISIWISHSIQLGNQSQIETCNQNVITYENNTWVNQTYVNISNTNFAAEQSVVPVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25173 - protein, 469 aa, Artificial Sequence
  neuraminidase__InfluenzaA__AHM98683
MNPNQKIITIGSVCMTIGMANLILQIGNIISIWISHSIQLGNQNQIETCNQSVITYENNTWVNQTYVNISNTNFDAGQSVVSVRLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGFNWLTIGISGPDNGAVAVLKYNGIITDTIRSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25174 - protein, 469 aa, Artificial Sequence; identical to SEQ ID NO: 20709
  neuraminidase__InfluenzaA__AHM98693

SEQ ID NO: 25175 - protein, 469 aa, Artificial Sequence; identical to SEQ ID NO: 23158
  neuraminidase__InfluenzaA__AHM98704

SEQ ID NO: 25176 - protein, 469 aa, Artificial Sequence; identical to SEQ ID NO: 23158
  neuraminidase__InfluenzaA__AHM98715

SEQ ID NO: 25177 - protein, 469 aa, Artificial Sequence; identical to SEQ ID NO: 20709
  neuraminidase__InfluenzaA__AHM98726

SEQ ID NO: 25178 - protein, 469 aa, Artificial Sequence
  neuraminidase__InfluenzaA__AHM98737
MNPNQKIITIGSVCMTIGMANLILQIGNIISIWISHSIQLRNQSQIETCNQSVINYENNTWVNQTYVNISNTNFAAGQSVVSVKLAGNSSLCPVSGWAIYSKDNSIRIGSKGDVFVIREPFVSCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNDILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25179 - protein, 469 aa, Artificial Sequence; identical to SEQ ID NO: 23158
  neuraminidase__InfluenzaA__AHM98748

SEQ ID NO: 25180 - protein, 469 aa, Artificial Sequence; identical to SEQ ID NO: 23158
  neuraminidase__InfluenzaA__AHM98759

SEQ ID NO: 25181 - protein, 469 aa, Artificial Sequence
  neuraminidase__InfluenzaA__AHM98770
MNPNQKIITIGSVCMTIGMANLILQIGNIISIWISHSIQLRNQSQIETCNQSAITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25182 - protein, 469 aa, Artificial Sequence
  neuraminidase__InfluenzaA__AHM98781
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPSDKTGSCGPVSSNGANGVKGFSFKYGNGVWIGRTKSISSRKGFEMIWDPNGWTGTDNSFSIKQDIVGINEWSGYSGSFVQHPELTGLDCIRPCFWVELIRGRPKENTIWTSGSSISFCGVNSGTVGWSWPDGAELPFTIDK

SEQ ID NO: 25183 - protein, 469 aa, Artificial Sequence; identical to SEQ ID NO: 20709
  neuraminidase__InfluenzaA__AHM98801

SEQ ID NO: 25184 - protein, 469 aa, Artificial Sequence; identical to SEQ ID NO: 20257
  neuraminidase__InfluenzaA__AHM98812

SEQ ID NO: 25185 - protein, 469 aa, Artificial Sequence
  neuraminidase__InfluenzaA__AHM98823
MNPNQKIITIGSVCMTIGMANLILQIGNIISIWISHSIQLGNQSQIETCNQSVITYENNTWVNQTYINISNTNFAAGQSVVSVKLAGNSSLCPVSGWAIYSKDNSIRIGSKGDVFVIREPFISCSPSECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25186 - protein, 469 aa, Artificial Sequence
  neuraminidase__InfluenzaA__AHM98839
MNPNQKIITIGSVCMTVGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25187 - protein, 469 aa, Artificial Sequence; identical to SEQ ID NO: 20257
  neuraminidase__InfluenzaA__AHM98850

SEQ ID NO: 25188 - protein, 469 aa, Artificial Sequence; identical to SEQ ID NO: 20257
  neuraminidase__InfluenzaA__AHM98861

SEQ ID NO: 25189 - protein, 469 aa, Artificial Sequence
  neuraminidase__InfluenzaA__AHM98901
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPHRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25190 - protein, 469 aa, Artificial Sequence; identical to SEQ ID NO: 23846
  neuraminidase__InfluenzaA__AHM98912

SEQ ID NO: 25191 - protein, 469 aa, Artificial Sequence; identical to SEQ ID NO: 23846
  neuraminidase__InfluenzaA__AHM98923

SEQ ID NO: 25192 - protein, 469 aa, Artificial Sequence; identical to SEQ ID NO: 23846
  neuraminidase__InfluenzaA__AHM98935

SEQ ID NO: 25193 - protein, 469 aa, Artificial Sequence; identical to SEQ ID NO: 23846
  neuraminidase__InfluenzaA__AHM98943

SEQ ID NO: 25194 - protein, 469 aa, Artificial Sequence; identical to SEQ ID NO: 23846
  neuraminidase__InfluenzaA__AHM98954

SEQ ID NO: 25195 - protein, 469 aa, Artificial Sequence; identical to SEQ ID NO: 23846
  neuraminidase__InfluenzaA__AHM98972

SEQ ID NO: 25196 - protein, 469 aa, Artificial Sequence; identical to SEQ ID NO: 23846
  neuraminidase__InfluenzaA__AHM98978

SEQ ID NO: 25197 - protein, 469 aa, Artificial Sequence; identical to SEQ ID NO: 23846
  neuraminidase__InfluenzaA__AHM98990

SEQ ID NO: 25198 - protein, 469 aa, Artificial Sequence; identical to SEQ ID NO: 23846
  neuraminidase__InfluenzaA__AHM99000

SEQ ID NO: 25199 - protein, 469 aa, Artificial Sequence; identical to SEQ ID NO: 23846
  neuraminidase__InfluenzaA__AHM99011

SEQ ID NO: 25200 - protein, 469 aa, Artificial Sequence; identical to SEQ ID NO: 23822
  neuraminidase__InfluenzaA__AHM99022

SEQ ID NO: 25201 - protein, 469 aa, Artificial Sequence; identical to SEQ ID NO: 23822
  neuraminidase__InfluenzaA__AHM99034

SEQ ID NO: 25202 - protein, 469 aa, Artificial Sequence; identical to SEQ ID NO: 23822
  neuraminidase__InfluenzaA__AHM99046

SEQ ID NO: 25203 - protein, 469 aa, Artificial Sequence; identical to SEQ ID NO: 23822
  neuraminidase__InfluenzaA__AHM99057

SEQ ID NO: 25204 - protein, 469 aa, Artificial Sequence; identical to SEQ ID NO: 23822
  neuraminidase__InfluenzaA__AHM99068

SEQ ID NO: 25205 - protein, 469 aa, Artificial Sequence; identical to SEQ ID NO: 23846
  neuraminidase__InfluenzaA__AHM99078

SEQ ID NO: 25206 - protein, 469 aa, Artificial Sequence
  neuraminidase__InfluenzaA__AHN00720
MNTNQRIITIGTICLIVGIISLLLQIGNIVSLWISHSIQTEEKSHPEVCNQSVITYENNTWVNQTYINISNTNIAAGQGVTPIILAGNSSLCPISGWAIYSKDNSIRIGSKGDIFVMREPFISCSHLECRTFFLTQGALLNDRHSNGTVKDRSPYRTLMSCPIGEAPSPYNSRFESVAWSASACHDGMGWLTIGISGPDNGAVAVLKYNGIITDTMKSWRNKILRTQESECVCINGSCFTIMTDGPSNGQASYKIFKMEKGKIIKSIELDAPNYHYEECSCYPDTGKVVCVCRDNWHASNRPWVSFDQNLDYQIGYICSGVFGDNPRSNDGKGNCGPVLSNGANGVKGFSFRYGNGVWIGRTKSISSRSGFEMIWDPNGWTETDSSFSMKQDIIALTDWSGYSGSFVQHPELTGMNCIRPCFWVELIRGQPKESTIWTSGSSISFCGVNSETASWSWPDGADLPFTIDK

SEQ ID NO: 25207 - protein, 469 aa, Artificial Sequence
  neuraminidase__InfluenzaA__AHN00767
MNTNQRIITIGTICLIVGIISLLLQIGNIVSLWISHSIQTGEKSHPEVCNQSVITYENNTWVNQTYVNISNTNIAAGQGVTPIILAGNSSLCPISGWAIYSKDNSIRIGSKGDIFVMREPFISCSHLECRTFFLTQGALLNDRHSNGTVKDRSPYRTLMSCPIGEAPSPYNSRFESVAWSASACHDGMGWLTIGISGPDNGAVAVLKYNGIITDTIKSWRNKILRTQESECVCINGSCFTIMTDGPSNGQASYKIFKMEKGKIIKSIELDAPNYHYEECSCYPDTGKVVCVCRDNWHASNRPWVSFDQNLDYQIGYICSGVFGDNPRSNDGKGNCGPVLSNGANGVKGFSFRYGNGVWIGRTKSISSRSGFEMIWDPNGWTETDSSFSMKQDIIALTDWSGYSGSFVQHPELTGMNCIRPCFWVELIRGQPKESTIWTSGSSISFCGVNSETASWSWPDGADLPFTIDK

SEQ ID NO: 25208 - protein, 465 aa, Artificial Sequence
  neuraminidase__InfluenzaA__AHN96324
MNPNQKILCTSATAIIIGAIAVLIGIANLGLNIGLHLKPSCNCSHSQPETTNTSQTIINNYYNETNITNIQMEERTSRNFNNLTKGLCTINSWHIYGKDNAVRIGESSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKILKWESLTGTAKHIEECSCYGERTGITCTCRDNWQGSNRPVVQIDPVAMTHTSQYICSPVLTDNPRPNDPNIGKCNDPYPGNNNNGVKGFSYLDGANTWLGRTISTASRSGYEMLKVPNALTDDRSKPIQGQTIVLNADWSGYSGSFMDYWAEGDCYRACFYVELIRGRPKEDKVWWTSNSIVSMCSSTEFLGQWNWPDGAKIEYFL

SEQ ID NO: 25209 - protein, 469 aa, Artificial Sequence; identical to SEQ ID NO: 21143
  neuraminidase__InfluenzaA__AHN96448

SEQ ID NO: 25210 - protein, 469 aa, Artificial Sequence; identical to SEQ ID NO: 22146
  neuraminidase__InfluenzaA__AHN96450

SEQ ID NO: 25211 - protein, 469 aa, Artificial Sequence
  neuraminidase__InfluenzaA__AHN96451
MNPNQKIITIGSVSLTISTICFFMQIAILITTVTLHFKQYEFNSPPNNQVMLCEPTIIERNITEIMYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25212 - protein, 469 aa, Artificial Sequence
  neuraminidase__InfluenzaA__AHN96453
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLDNVHSNNTVRNRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSIEGKSCINRCFYVELIRGRKEETEVLWTSNSIVVFCGTSGTYGTGSWPDGADLNLMPI

SEQ ID NO: 25213 - protein, 469 aa, Artificial Sequence
  neuraminidase__InfluenzaA__AHZ13526
MNPNQKIITIGSVSLTIATICFLMQIAILVTTVTLHFKQYECSSPPNNQVMPCEPIIIERNMTEIVYLTNTTIEKEICPKLVEYRNWSKPQCKITGFAPFSKDNSIRLSAGGDIWVTREPYVSCDPGKCYQFALGQGTTLNNKHSNDTIHDRTPYRTLLMNELGVPFHLGTKQVCIAWSSSSCHDGKAWLHVCVTGHDKNATASFIYDGRLVDSIGSWSKNILRTQESECVCINGTCTVVMTDGSASDRADTKILFIEEGKIVHISPLSGSAQHVEECSCYPRYPGVRCVCRDNWKGSNRPIVDINVKDYSIVSSYVCSGLVGDTPRKNDGSSSSYCRNPNNEKGNHGVKGWAFDDGNDVWMGRTIGEELRSGYETFKVIGGWSTPNSKLQINRQVIVDSNNRSGYSGIFSVEGKSCINRCFYVELIRGREQETRVWWTSNSIVVFCGTSGTYGTGSWPDGADINLMPI

SEQ ID NO: 25214 - protein, 470 aa, Artificial Sequence; identical to SEQ ID NO: 20205
  neuraminidase__InfluenzaA__AHZ13584

SEQ ID NO: 25215 - protein, 469 aa, Artificial Sequence; identical to SEQ ID NO: 22922
  neuraminidase__InfluenzaA__AHZ35575

SEQ ID NO: 25216 - protein, 469 aa, Artificial Sequence; identical to SEQ ID NO: 22922
  neuraminidase__InfluenzaA__AHZ35587

SEQ ID NO: 25217 - protein, 469 aa, Artificial Sequence
  neuraminidase__InfluenzaA__AHZ35611
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGRSCINRCFYVELIRGRKEETEVLWTSNSIVVFCGTSGTYGTGSWPDGADLNLMPI

SEQ ID NO: 25218 - protein, 469 aa, Artificial Sequence; identical to SEQ ID NO: 22922
  neuraminidase__InfluenzaA__AHZ35623

SEQ ID NO: 25219 - protein, 469 aa, Artificial Sequence; identical to SEQ ID NO: 22922
  neuraminidase__InfluenzaA__AHZ35635

SEQ ID NO: 25220 - protein, 469 aa, Artificial Sequence
  neuraminidase__InfluenzaA__AHZ35647
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPDVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25221 - protein, 469 aa, Artificial Sequence; identical to SEQ ID NO: 22922
  neuraminidase__InfluenzaA__AHZ35659

SEQ ID NO: 25222 - protein, 469 aa, Artificial Sequence; identical to SEQ ID NO: 22922
  neuraminidase__InfluenzaA__AHZ35671

SEQ ID NO: 25223 - protein, 469 aa, Artificial Sequence; identical to SEQ ID NO: 22922
  neuraminidase__InfluenzaA__AHZ35683

SEQ ID NO: 25224 - protein, 469 aa, Artificial Sequence
  neuraminidase__InfluenzaA__AHZ35695
MNPNQKIITIGSVSLTISTICFFMQIAILITTVTLHFKQYEFNPPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNERLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGNSCINRCFYVELIRGRKEETEVLWTSNSIVVFCGTSGTYGTGSWPDGADLNLMPI

SEQ ID NO: 25225 - protein, 469 aa, Artificial Sequence
  neuraminidase__InfluenzaA__AHZ35719
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLTPI

SEQ ID NO: 25226 - protein, 469 aa, Artificial Sequence; identical to SEQ ID NO: 22922
  neuraminidase__InfluenzaA__AHZ35731

SEQ ID NO: 25227 - protein, 469 aa, Artificial Sequence; identical to SEQ ID NO: 22922
  neuraminidase__InfluenzaA__AHZ35743

SEQ ID NO: 25228 - protein, 469 aa, Artificial Sequence; identical to SEQ ID NO: 22922
  neuraminidase__InfluenzaA__AHZ35755

SEQ ID NO: 25229 - protein, 469 aa, Artificial Sequence; identical to SEQ ID NO: 22922
  neuraminidase__InfluenzaA__AHZ35767

SEQ ID NO: 25230 - protein, 469 aa, Artificial Sequence; identical to SEQ ID NO: 22922
  neuraminidase__InfluenzaA__AHZ35779

SEQ ID NO: 25231 - protein, 469 aa, Artificial Sequence
  neuraminidase__InfluenzaA__AHZ35803
MNPNQKIITIGSVCMTIGMANLMLQIGNIISIWISHSIQLGNKNQIETCNQSVITYENNTWVNQTYVNISNTNFAAGQSVVSVKIAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPHDKTGSCGPVSSNGANGVKGFSFKYGNGVWIGRTKSISSRKGFEMIWDPNGWTGTDNNFSIKQDIVGMNEWSGYSGSFVQHPELTGLDCIRPCFWVELIRGRPKENTIWTSGSSISFCGVNSDTVGWSWPDGAELPFTIDK

SEQ ID NO: 25232 - protein, 469 aa, Artificial Sequence
  neuraminidase__InfluenzaA__AHZ35814
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDLWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 25233 - protein, 469 aa, Artificial Sequence
  neuraminidase__InfluenzaA__AHZ35837
MNPNQKIITIGSVCMTIGMANLMLQIGNIISIWISHSIQLGNKNQIETCNQSVITYENNTWVNQTYVNISNTNFAAGQSVVSVKIAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPHDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25234 - protein, 469 aa, Artificial Sequence; identical to SEQ ID NO: 25233
  neuraminidase__InfluenzaA__AHZ35848

SEQ ID NO: 25235 - protein, 469 aa, Artificial Sequence; identical to SEQ ID NO: 25233
  neuraminidase__InfluenzaA__AHZ35859

SEQ ID NO: 25236 - protein, 469 aa, Artificial Sequence; identical to SEQ ID NO: 25232
  neuraminidase__InfluenzaA__AHZ35870

SEQ ID NO: 25237 - protein, 469 aa, Artificial Sequence; identical to SEQ ID NO: 25232
  neuraminidase__InfluenzaA__AHZ35882

SEQ ID NO: 25238 - protein, 469 aa, Artificial Sequence
  neuraminidase__InfluenzaA__AHZ35894
MNPNQKIITIGSVCMTIGMANLMLQIGNIISIWISHSIQLGNKNQIETCNQSVITYENNTWVNQTYVNISNTNFAAGQSVVSVKIAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPHDKTGSCGPVSSNGANGVKGFSFKYGSGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25239 - protein, 469 aa, Artificial Sequence; identical to SEQ ID NO: 25233
  neuraminidase__InfluenzaA__AHZ35905

SEQ ID NO: 25240 - protein, 469 aa, Artificial Sequence; identical to SEQ ID NO: 25233
  neuraminidase__InfluenzaA__AHZ35916

SEQ ID NO: 25241 - protein, 469 aa, Artificial Sequence; identical to SEQ ID NO: 20958
  neuraminidase__InfluenzaA__AHZ35927

SEQ ID NO: 25242 - protein, 469 aa, Artificial Sequence
  neuraminidase__InfluenzaA__AHZ35938
MNPNQKIITIGSVCMIIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPHDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25243 - protein, 469 aa, Artificial Sequence; identical to SEQ ID NO: 25232
  neuraminidase__InfluenzaA__AHZ35949

SEQ ID NO: 25244 - protein, 469 aa, Artificial Sequence
  neuraminidase__InfluenzaA__AHZ35961
MNPNQKIITIGSVCMTIGMANLMLQIGNIISIWISHSIQLGNKNQIETCNQSVITYENNTWVNQTYVNISNTNFAAGQSVVSVKIAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPHDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKESTIWTSGSSISFCGVNSDTVGWSWPDGAELPFTIDK

SEQ ID NO: 25245 - protein, 469 aa, Artificial Sequence; identical to SEQ ID NO: 25233
  neuraminidase__InfluenzaA__AHZ35972

SEQ ID NO: 25246 - protein, 469 aa, Artificial Sequence
  neuraminidase__InfluenzaA__AHZ35983
MNPNQKITTIGSVCMTIGMANLMLQIGNIISIWISHSIQLGNKNQIETCNQSVITYENNTWVNQTYVNISNTNFAAGQSVVSVKIAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPHDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25247 - protein, 469 aa, Artificial Sequence; identical to SEQ ID NO: 25233
  neuraminidase__InfluenzaA__AHZ35994

SEQ ID NO: 25248 - protein, 469 aa, Artificial Sequence; identical to SEQ ID NO: 25233
  neuraminidase__InfluenzaA__AHZ36005

SEQ ID NO: 25249 - protein, 469 aa, Artificial Sequence; identical to SEQ ID NO: 25233
  neuraminidase__InfluenzaA__AHZ36016

SEQ ID NO: 25250 - protein, 469 aa, Artificial Sequence
  neuraminidase__InfluenzaA__AHZ36027
MNPNQKIITIGSVCMTIGMANLILQIGNIISIWISHSIQLGNQNQIETCNQSVIIYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGFNWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIIGINEWSGYSGSFVQHPELTGLDCIRPCFWVELIRGRPKENTIWTSGSSISFCGVNSDTVGWSWPDGAELPFTIDK

SEQ ID NO: 25251 - protein, 469 aa, Artificial Sequence
  neuraminidase__InfluenzaA__AHZ36050
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRRNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 25252 - protein, 469 aa, Artificial Sequence
  neuraminidase__InfluenzaA__AHZ36062
MNPNQKIITIGSVCMTIGMANLMLQIGNIISIWISHSIQLGNKNQIETCNQSVITYENNTWVNQTYVNISNTNFAAGQSVVSVKIAGNSSLCPVSGWAIYSKDNSIRIGSKGDVFVIREPFISCSPLGCRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPHDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25253 - protein, 469 aa, Artificial Sequence; identical to SEQ ID NO: 25233
  neuraminidase__InfluenzaA__AHZ36084

SEQ ID NO: 25254 - protein, 469 aa, Artificial Sequence
  neuraminidase__InfluenzaA__AHZ36095
MNPNQKIITIGSVCMTIGMANLILQIGNIISIWISHSIQLGNQNQIETCNQSVIIYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGFNWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGGCGPVSSNGANGVKGFSFKYGNGVWIGRTKSISSRKGFEMIWDPNGWTGTDNNFSIKQDIIGINEWSGYSGSFVQHPELTGLDCIRPCFWVELIRGRPKENTIWTSGSSISFCGVNSDTVGWSWPDGAELPFTIDK

SEQ ID NO: 25255 - protein, 469 aa, Artificial Sequence; identical to SEQ ID NO: 25233
  neuraminidase__InfluenzaA__AHZ36106

SEQ ID NO: 25256 - protein, 469 aa, Artificial Sequence
  neuraminidase__InfluenzaA__AHZ36117
MNPNQKIITIGSVCMTIGMANLILQIGNIISIWISHSIQLGNQNQIETCNQSVIIYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCSIGEVPSPYNSRFESVAWSASACHDGFNWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIIGINEWSGYSGSFVQHPELTGLDCIRPCFWVELIRGRPKENTIWTSGSSISFCGVNSDTVGWSWPDGAELPFTIDK

SEQ ID NO: 25257 - protein, 469 aa, Artificial Sequence; identical to SEQ ID NO: 25233
  neuraminidase__InfluenzaA__AHZ36128

SEQ ID NO: 25258 - protein, 469 aa, Artificial Sequence; identical to SEQ ID NO: 25233
  neuraminidase__InfluenzaA__AHZ36139

SEQ ID NO: 25259 - protein, 469 aa, Artificial Sequence; identical to SEQ ID NO: 25251
  neuraminidase__InfluenzaA__AHZ36150

SEQ ID NO: 25260 - protein, 469 aa, Artificial Sequence; identical to SEQ ID NO: 25233
  neuraminidase__InfluenzaA__AHZ36161

SEQ ID NO: 25261 - protein, 469 aa, Artificial Sequence; identical to SEQ ID NO: 25233
  neuraminidase__InfluenzaA__AHZ36172

SEQ ID NO: 25262 - protein, 469 aa, Artificial Sequence
  neuraminidase__InfluenzaA__AHZ36183
MNPNQKIITIGSVCMTIGMANLMLQIGNIISIWISHSIQLGNKNQIETCNQSVITYENNTWVNQTYVNISNTNFAAGQSVVSVKIAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGILGDNPRPHDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25263 - protein, 469 aa, Artificial Sequence; identical to SEQ ID NO: 25232
  neuraminidase__InfluenzaA__AHZ36194

SEQ ID NO: 25264 - protein, 469 aa, Artificial Sequence; identical to SEQ ID NO: 25251
  neuraminidase__InfluenzaA__AHZ36206

SEQ ID NO: 25265 - protein, 469 aa, Artificial Sequence; identical to SEQ ID NO: 25233
  neuraminidase__InfluenzaA__AHZ36218

SEQ ID NO: 25266 - protein, 469 aa, Artificial Sequence; identical to SEQ ID NO: 25251
  neuraminidase__InfluenzaA__AHZ36229

SEQ ID NO: 25267 - protein, 469 aa, Artificial Sequence; identical to SEQ ID NO: 25233
  neuraminidase__InfluenzaA__AHZ36241

SEQ ID NO: 25268 - protein, 469 aa, Artificial Sequence; identical to SEQ ID NO: 25233
  neuraminidase__InfluenzaA__AHZ36252

SEQ ID NO: 25269 - protein, 469 aa, Artificial Sequence; identical to SEQ ID NO: 25233
  neuraminidase__InfluenzaA__AHZ36263

SEQ ID NO: 25270 - protein, 469 aa, Artificial Sequence; identical to SEQ ID NO: 22922
  neuraminidase__InfluenzaA__AHZ36274

SEQ ID NO: 25271 - protein, 469 aa, Artificial Sequence; identical to SEQ ID NO: 25233
  neuraminidase__InfluenzaA__AHZ36286

SEQ ID NO: 25272 - protein, 469 aa, Artificial Sequence
  neuraminidase__InfluenzaA__AHZ36297
MNPNQKIITIGSVSLTISTICFFMQIAILITTVTLHFKQYEFNSPPNNQVMLCEPTIIERNITEIVYLTNTTIEKEICPRPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGGAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25273 - protein, 469 aa, Artificial Sequence
  neuraminidase__InfluenzaA__AHZ36309
MNPNQKIITIGSVCMTIGMANLMLQIGNIISIWISHSIQLGDKNQIETCNQSVITYENNTWVNQTYVNISNTNFAAGQSVVSVKIAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPHDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25274 - protein, 469 aa, Artificial Sequence; identical to SEQ ID NO: 25233
  neuraminidase__InfluenzaA__AHZ36320

SEQ ID NO: 25275 - protein, 469 aa, Artificial Sequence; identical to SEQ ID NO: 25233
  neuraminidase__InfluenzaA__AHZ36331

SEQ ID NO: 25276 - protein, 469 aa, Artificial Sequence; identical to SEQ ID NO: 22922
  neuraminidase__InfluenzaA__AHZ36353

SEQ ID NO: 25277 - protein, 469 aa, Artificial Sequence
  neuraminidase__InfluenzaA__AHZ36365
MNPNQKIITIGSVCMTIGMANLMLQIGNIISIWISHPIQLGNKNQIETCNQSVITYENNTWVNQTYVNISNTNFAAGQSVVSVKIAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPHDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25278 - protein, 469 aa, Artificial Sequence; identical to SEQ ID NO: 22922
  neuraminidase__InfluenzaA__AHZ36376

SEQ ID NO: 25279 - protein, 469 aa, Artificial Sequence; identical to SEQ ID NO: 22922
  neuraminidase__InfluenzaA__AHZ36388

SEQ ID NO: 25280 - protein, 469 aa, Artificial Sequence; identical to SEQ ID NO: 22922
  neuraminidase__InfluenzaA__AHZ36400

SEQ ID NO: 25281 - protein, 469 aa, Artificial Sequence; identical to SEQ ID NO: 22922
  neuraminidase__InfluenzaA__AHZ36412

SEQ ID NO: 25282 - protein, 469 aa, Artificial Sequence; identical to SEQ ID NO: 22922
  neuraminidase__InfluenzaA__AHZ36424

SEQ ID NO: 25283 - protein, 469 aa, Artificial Sequence; identical to SEQ ID NO: 22922
  neuraminidase__InfluenzaA__AHZ36436

SEQ ID NO: 25284 - protein, 469 aa, Artificial Sequence
  neuraminidase__InfluenzaA__AHZ36448
MNPNQKIITIGSVSLTISTICFFMQIAILITTVTLHFKQYEFNSPPNNQVMLCEPTIIEKNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25285 - protein, 469 aa, Artificial Sequence; identical to SEQ ID NO: 22922
  neuraminidase__InfluenzaA__AHZ36460

SEQ ID NO: 25286 - protein, 469 aa, Artificial Sequence; identical to SEQ ID NO: 22922
  neuraminidase__InfluenzaA__AHZ36472

SEQ ID NO: 25287 - protein, 469 aa, Artificial Sequence; identical to SEQ ID NO: 22922
  neuraminidase__InfluenzaA__AHZ36484

SEQ ID NO: 25288 - protein, 469 aa, Artificial Sequence; identical to SEQ ID NO: 22922
  neuraminidase__InfluenzaA__AHZ36496

SEQ ID NO: 25289 - protein, 469 aa, Artificial Sequence; identical to SEQ ID NO: 22922
  neuraminidase__InfluenzaA__AHZ36508

SEQ ID NO: 25290 - protein, 469 aa, Artificial Sequence; identical to SEQ ID NO: 22922
  neuraminidase__InfluenzaA__AHZ36520

SEQ ID NO: 25291 - protein, 469 aa, Artificial Sequence
  neuraminidase__InfluenzaA__AHZ36532
MNPNQKIITIGSVSLTISTICFFMQIAILITTVTLHFKQYEFNSPPNNQVMLCEPTIIERNITEIVYLTNTTIEKEICPKPAEYRTWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25292 - protein, 469 aa, Artificial Sequence; identical to SEQ ID NO: 22922
  neuraminidase__InfluenzaA__AHZ36544

SEQ ID NO: 25293 - protein, 469 aa, Artificial Sequence; identical to SEQ ID NO: 22922
  neuraminidase__InfluenzaA__AHZ36556

SEQ ID NO: 25294 - protein, 469 aa, Artificial Sequence; identical to SEQ ID NO: 22922
  neuraminidase__InfluenzaA__AHZ36568

SEQ ID NO: 25295 - protein, 469 aa, Artificial Sequence; identical to SEQ ID NO: 22922
  neuraminidase__InfluenzaA__AHZ36580

SEQ ID NO: 25296 - protein, 469 aa, Artificial Sequence; identical to SEQ ID NO: 22922
  neuraminidase__InfluenzaA__AHZ36592

SEQ ID NO: 25297 - protein, 469 aa, Artificial Sequence; identical to SEQ ID NO: 22922
  neuraminidase__InfluenzaA__AHZ36604

SEQ ID NO: 25298 - protein, 469 aa, Artificial Sequence; identical to SEQ ID NO: 22922
  neuraminidase__InfluenzaA__AHZ36616

SEQ ID NO: 25299 - protein, 469 aa, Artificial Sequence
  neuraminidase__InfluenzaA__AHZ36628
MNPNQKIITIGSVSLTISTICFFMQIAILITTVTLHFKQCEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25300 - protein, 469 aa, Artificial Sequence
  neuraminidase__InfluenzaA__AHZ36640
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVHDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25301 - protein, 469 aa, Artificial Sequence; identical to SEQ ID NO: 22922
  neuraminidase__InfluenzaA__AHZ36652

SEQ ID NO: 25302 - protein, 469 aa, Artificial Sequence; identical to SEQ ID NO: 22146
  neuraminidase__InfluenzaA__AHZ36664

SEQ ID NO: 25303 - protein, 469 aa, Artificial Sequence; identical to SEQ ID NO: 22146
  neuraminidase__InfluenzaA__AHZ36676

SEQ ID NO: 25304 - protein, 469 aa, Artificial Sequence; identical to SEQ ID NO: 22146
  neuraminidase__InfluenzaA__AHZ36688

SEQ ID NO: 25305 - protein, 465 aa, Artificial Sequence; identical to SEQ ID NO: 23454
  neuraminidase__InfluenzaA__AHZ39689

SEQ ID NO: 25306 - protein, 465 aa, Artificial Sequence; identical to SEQ ID NO: 23454
  neuraminidase__InfluenzaA__AHZ39713

SEQ ID NO: 25307 - protein, 465 aa, Artificial Sequence; identical to SEQ ID NO: 23454
  neuraminidase__InfluenzaA__AHZ39725

SEQ ID NO: 25308 - protein, 465 aa, Artificial Sequence; identical to SEQ ID NO: 23454
  neuraminidase__InfluenzaA__AHZ39737

SEQ ID NO: 25309 - protein, 465 aa, Artificial Sequence
  neuraminidase__InfluenzaA__AHZ39749
MNPNQKILCISATAIIIGAIAVLIGIANLGLNIGLHLKPGCNCSHSQPETTNTSQTIINNYYNETNITNIQMEERTSRNFNNLTKGLCTINSWHIYGKDNAVRIGESSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKILKWESLTGTAKHIEECSCYGERTGITCTCRDNWQGSNRPVIQIDPVAMTHTSQYICSPVLTDNPRPNDPNIGKCNDPYPGNNNNGVKGFSYLDGANTWLGRTISTASRSGYEMLKVPNALTDDRSKPIQGQTIVLNADWSGYSGSFMDYWAEGDCYRACFYVELIRGRPKEDKVWWTSNSIVSMCSSTEFLGQWNWPDGAKIEYFL

SEQ ID NO: 25310 - protein, 465 aa, Artificial Sequence; identical to SEQ ID NO: 25309
  neuraminidase__InfluenzaA__AHZ39761

SEQ ID NO: 25311 - protein, 465 aa, Artificial Sequence; identical to SEQ ID NO: 23454
  neuraminidase__InfluenzaA__AHZ39773

SEQ ID NO: 25312 - protein, 465 aa, Artificial Sequence; identical to SEQ ID NO: 23454
  neuraminidase__InfluenzaA__AHZ39785

SEQ ID NO: 25313 - protein, 469 aa, Artificial Sequence
  neuraminidase__InfluenzaA__AHZ39797
MNPNQKIITIGSVSLTISTVCFFMQIAILITTVTLHFKQYEFNPPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKSDTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25314 - protein, 469 aa, Artificial Sequence
  neuraminidase__InfluenzaA__AHZ39821
MNPNQKIITIGSVSLTISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRRNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPT

SEQ ID NO: 25315 - protein, 469 aa, Artificial Sequence; identical to SEQ ID NO: 23389
  neuraminidase__InfluenzaA__AHZ39833

SEQ ID NO: 25316 - protein, 469 aa, Artificial Sequence; identical to SEQ ID NO: 22146
  neuraminidase__InfluenzaA__AHZ39844

SEQ ID NO: 25317 - protein, 469 aa, Artificial Sequence
  neuraminidase__InfluenzaA__AHZ39856
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSRYVCSGLVGDTPRKNDSSSSSHCLDPNNEEGGHGVKGWAFDDGNDVWMGRTINETSRLGYETFKVIEGWSNPKSKLPINRQVIVDRGDRSGYSGIFSVEGKSCINRCFYVELIRGRKEETEVLWTSNSIVVFCGTSGTYGTGSWPDGADLNLMPI

SEQ ID NO: 25318 - protein, 469 aa, Artificial Sequence; identical to SEQ ID NO: 22146
  neuraminidase__InfluenzaA__AHZ39868

SEQ ID NO: 25319 - protein, 469 aa, Artificial Sequence
  neuraminidase__InfluenzaA__AHZ39892
MNPNQKIITIGSVSLTISTICFFMQIAILITTVTLHFKQYEFNSPPNNQVVLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSRYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25320 - protein, 469 aa, Artificial Sequence; identical to SEQ ID NO: 23354
  neuraminidase__InfluenzaA__AHZ39904

SEQ ID NO: 25321 - protein, 469 aa, Artificial Sequence; identical to SEQ ID NO: 23354
  neuraminidase__InfluenzaA__AHZ39916

SEQ ID NO: 25322 - protein, 469 aa, Artificial Sequence; identical to SEQ ID NO: 22146
  neuraminidase__InfluenzaA__AHZ39928

SEQ ID NO: 25323 - protein, 469 aa, Artificial Sequence
  neuraminidase__InfluenzaA__AHZ39940
MNPNQKIITIGSVSLTISTICFFMQIAILITTVTLHFKQYEFNSPPNNQVMLCEPTIIERNMTEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKTDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25324 - protein, 469 aa, Artificial Sequence; identical to SEQ ID NO: 22146
  neuraminidase__InfluenzaA__AHZ39952

SEQ ID NO: 25325 - protein, 469 aa, Artificial Sequence; identical to SEQ ID NO: 22146
  neuraminidase__InfluenzaA__AHZ39976

SEQ ID NO: 25326 - protein, 469 aa, Artificial Sequence
  neuraminidase__InfluenzaA__AHZ39988
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSTQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25327 - protein, 469 aa, Artificial Sequence; identical to SEQ ID NO: 22146
  neuraminidase__InfluenzaA__AHZ40000

SEQ ID NO: 25328 - protein, 469 aa, Artificial Sequence; identical to SEQ ID NO: 22146
  neuraminidase__InfluenzaA__AHZ40012

SEQ ID NO: 25329 - protein, 469 aa, Artificial Sequence
  neuraminidase__InfluenzaA__AHZ40024
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGFETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25330 - protein, 469 aa, Artificial Sequence; identical to SEQ ID NO: 22146
  neuraminidase__InfluenzaA__AHZ40036

SEQ ID NO: 25331 - protein, 469 aa, Artificial Sequence; identical to SEQ ID NO: 23357
  neuraminidase__InfluenzaA__AHZ40048

SEQ ID NO: 25332 - protein, 469 aa, Artificial Sequence; identical to SEQ ID NO: 22146
  neuraminidase__InfluenzaA__AHZ40063

SEQ ID NO: 25333 - protein, 469 aa, Artificial Sequence
  neuraminidase__InfluenzaA__AHZ40075
MNPNQKIITIGSVSLTISTVCFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNSKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25334 - protein, 469 aa, Artificial Sequence; identical to SEQ ID NO: 22146
  neuraminidase__InfluenzaA__AHZ40087

SEQ ID NO: 25335 - protein, 469 aa, Artificial Sequence; identical to SEQ ID NO: 23357
  neuraminidase__InfluenzaA__AHZ40099

SEQ ID NO: 25336 - protein, 469 aa, Artificial Sequence
  neuraminidase__InfluenzaA__AHZ40111
MNPNQKIITIGSVSLTISTICFFMQIAILITTVTLHFKQYEFNPPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCAVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSGHCLDPNNEEGGHGVKGWAFDDGNDVWMGRTINETSRLGYETFKVIEGWSNPKSKLQINRQVIVDRGNRSGYSGIFSVEGKNCINRCFYVELIRGRKEETEVLWTSNSIVVFCGTSGTYGTGSWPDGADLNLMPI

SEQ ID NO: 25337 - protein, 469 aa, Artificial Sequence
  neuraminidase__InfluenzaA__AHZ40123
MNPNQKIITIGSVSLTISTICFFMQIAILITTVTLHFKQYEFNSPPNNQVMLCEPTITERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTRTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25338 - protein, 469 aa, Artificial Sequence; identical to SEQ ID NO: 22146
  neuraminidase__InfluenzaA__AHZ40133

SEQ ID NO: 25339 - protein, 469 aa, Artificial Sequence; identical to SEQ ID NO: 23364
  neuraminidase__InfluenzaA__AHZ40145

SEQ ID NO: 25340 - protein, 469 aa, Artificial Sequence
  neuraminidase__InfluenzaA__AHZ40157
MNPNQKIITIGSVSLTISTICFFMQIAILITTVTLHFKQYEFNSPPNNQVMLCEPTIIERNITEIVYLTNTTIEKELCPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCMAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKTDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETAVLWTSNSIVVFCGTSGTYGTGSWPDGADLNLMPI

SEQ ID NO: 25341 - protein, 469 aa, Artificial Sequence
  neuraminidase__InfluenzaA__AHZ40169
MNPNQKIITIGSVCMTIGMANLILQIGNIISIWISHSIQLENQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25342 - protein, 469 aa, Artificial Sequence
  neuraminidase__InfluenzaA__AHZ40180
MNPNQKIITIGSVSLTISTICFFMQITILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25343 - protein, 469 aa, Artificial Sequence; identical to SEQ ID NO: 23010
  neuraminidase__InfluenzaA__AHZ40192

SEQ ID NO: 25344 - protein, 469 aa, Artificial Sequence; identical to SEQ ID NO: 22146
  neuraminidase__InfluenzaA__AHZ40204

SEQ ID NO: 25345 - protein, 469 aa, Artificial Sequence; identical to SEQ ID NO: 22146
  neuraminidase__InfluenzaA__AHZ40216

SEQ ID NO: 25346 - protein, 469 aa, Artificial Sequence; identical to SEQ ID NO: 23375
  neuraminidase__InfluenzaA__AHZ40228

SEQ ID NO: 25347 - protein, 469 aa, Artificial Sequence
  neuraminidase__InfluenzaA__AHZ40240
MNPNQKIITIGSVSLTISTICFLMQIAILITTATLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDRSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25348 - protein, 469 aa, Artificial Sequence
  neuraminidase__InfluenzaA__AHZ40252
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGEDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25349 - protein, 469 aa, Artificial Sequence; identical to SEQ ID NO: 25094
  neuraminidase__InfluenzaA__AHZ40264

SEQ ID NO: 25350 - protein, 469 aa, Artificial Sequence; identical to SEQ ID NO: 22146
  neuraminidase__InfluenzaA__AHZ40276

SEQ ID NO: 25351 - protein, 469 aa, Artificial Sequence
  neuraminidase__InfluenzaA__AHZ40288
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVISWSKDILRTQESECVCINGTCAVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSGHCLDPNNEEGGHGVKGWAFDDGNDVWMGRTINETSRLGYETFKVIEGWSNPKSKLQINRQVIVDRGNRSGYSGIFSVEGKNCINRCFYVELIRGRKEETEVLWTSNSIVVFCGTSGTYGTGSWPDGADLNLMPI

SEQ ID NO: 25352 - protein, 469 aa, Artificial Sequence
  neuraminidase__InfluenzaA__AHZ40312
MNPNQKIITIGSVSLTISTICFFMQIAILITTVTLHFKQYEFNYPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSVVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25353 - protein, 469 aa, Artificial Sequence; identical to SEQ ID NO: 22146
  neuraminidase__InfluenzaA__AHZ40324

SEQ ID NO: 25354 - protein, 469 aa, Artificial Sequence; identical to SEQ ID NO: 22146
  neuraminidase__InfluenzaA__AHZ40336

SEQ ID NO: 25355 - protein, 469 aa, Artificial Sequence; identical to SEQ ID NO: 25329
  neuraminidase__InfluenzaA__AHZ40348

SEQ ID NO: 25356 - protein, 469 aa, Artificial Sequence; identical to SEQ ID NO: 23354
  neuraminidase__InfluenzaA__AHZ40360

SEQ ID NO: 25357 - protein, 469 aa, Artificial Sequence
  neuraminidase__InfluenzaA__AHZ40372
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGDHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25358 - protein, 469 aa, Artificial Sequence; identical to SEQ ID NO: 23010
  neuraminidase__InfluenzaA__AHZ40384

SEQ ID NO: 25359 - protein, 469 aa, Artificial Sequence; identical to SEQ ID NO: 22146
  neuraminidase__InfluenzaA__AHZ40396

SEQ ID NO: 25360 - protein, 469 aa, Artificial Sequence; identical to SEQ ID NO: 22146
  neuraminidase__InfluenzaA__AHZ40408

SEQ ID NO: 25361 - protein, 469 aa, Artificial Sequence; identical to SEQ ID NO: 22146
  neuraminidase__InfluenzaA__AHZ40420

SEQ ID NO: 25362 - protein, 469 aa, Artificial Sequence
  neuraminidase__InfluenzaA__AHZ40432
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIIDINIKDHSIVSRYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25363 - protein, 469 aa, Artificial Sequence; identical to SEQ ID NO: 22146
  neuraminidase__InfluenzaA__AHZ40444

SEQ ID NO: 25364 - protein, 469 aa, Artificial Sequence
  neuraminidase__InfluenzaA__AHZ40456
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25365 - protein, 469 aa, Artificial Sequence
  neuraminidase__InfluenzaA__AHZ40468
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGNDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25366 - protein, 469 aa, Artificial Sequence; identical to SEQ ID NO: 23354
  neuraminidase__InfluenzaA__AHZ40480

SEQ ID NO: 25367 - protein, 469 aa, Artificial Sequence; identical to SEQ ID NO: 24792
  neuraminidase__InfluenzaA__AHZ40492

SEQ ID NO: 25368 - protein, 469 aa, Artificial Sequence; identical to SEQ ID NO: 22146
  neuraminidase__InfluenzaA__AHZ40503

SEQ ID NO: 25369 - protein, 469 aa, Artificial Sequence; identical to SEQ ID NO: 22146
  neuraminidase__InfluenzaA__AHZ40515

SEQ ID NO: 25370 - protein, 469 aa, Artificial Sequence
  neuraminidase__InfluenzaA__AHZ40527
MNPNQKIITIGSVSLTISTMCFFMQIAILITTVTLHFKQYEFDSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25371 - protein, 469 aa, Artificial Sequence
  neuraminidase__InfluenzaA__AHZ40539
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVNTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25372 - protein, 469 aa, Artificial Sequence; identical to SEQ ID NO: 22146
  neuraminidase__InfluenzaA__AHZ40551

SEQ ID NO: 25373 - protein, 469 aa, Artificial Sequence
  neuraminidase__InfluenzaA__AHZ40563
MNPNQKIITIGSVSLTISTVCFFMQIAILITTVTLHFKQYEFNSSPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNSKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25374 - protein, 469 aa, Artificial Sequence
  neuraminidase__InfluenzaA__AHZ40575
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQISRQVIVDRGDRSGYSGIFSVEGKSCINRCFYVELIRGRKEETEVLWTSNSIVVFCGTSGTYGTGSWPDGADLNLMPI

SEQ ID NO: 25375 - protein, 469 aa, Artificial Sequence; identical to SEQ ID NO: 25093
  neuraminidase__InfluenzaA__AHZ40586

SEQ ID NO: 25376 - protein, 469 aa, Artificial Sequence
  neuraminidase__InfluenzaA__AHZ40598
MNPNQKIITIGSVCMTIGMANLILQIGNIISIWISHSIQVGNQSQIETCNQSVITYENNTWVNQTYVNISNTNFAAGQPVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNDILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25377 - protein, 469 aa, Artificial Sequence; identical to SEQ ID NO: 22146
  neuraminidase__InfluenzaA__AHZ40609

SEQ ID NO: 25378 - protein, 469 aa, Artificial Sequence; identical to SEQ ID NO: 23375
  neuraminidase__InfluenzaA__AHZ40629

SEQ ID NO: 25379 - protein, 469 aa, Artificial Sequence; identical to SEQ ID NO: 23357
  neuraminidase__InfluenzaA__AHZ40641

SEQ ID NO: 25380 - protein, 469 aa, Artificial Sequence
  neuraminidase__InfluenzaA__AHZ40653
MNPNQKIITIGSVSLTISTICFFMQIAILITTVTLHFKQYEFNSPPNNQVMLCEPTIIERNITEIVYLTNTTIEKEICPKPAGYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25381 - protein, 469 aa, Artificial Sequence; identical to SEQ ID NO: 23375
  neuraminidase__InfluenzaA__AHZ40665

SEQ ID NO: 25382 - protein, 469 aa, Artificial Sequence; identical to SEQ ID NO: 23375
  neuraminidase__InfluenzaA__AHZ40677

SEQ ID NO: 25383 - protein, 469 aa, Artificial Sequence; identical to SEQ ID NO: 22146
  neuraminidase__InfluenzaA__AHZ40689

SEQ ID NO: 25384 - protein, 469 aa, Artificial Sequence
  neuraminidase__InfluenzaA__AHZ40713
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDKSGYSGIFSVEGKSCINRCFYVELIRGRKEETEVLWTSNSIVVFCGTSGTYGTGSWPDGADLNLMPI

SEQ ID NO: 25385 - protein, 469 aa, Artificial Sequence
  neuraminidase__InfluenzaA__AHZ40725
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSGYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25386 - protein, 469 aa, Artificial Sequence; identical to SEQ ID NO: 23364
  neuraminidase__InfluenzaA__AHZ40737

SEQ ID NO: 25387 - protein, 469 aa, Artificial Sequence
  neuraminidase__InfluenzaA__AHZ40749
MNPNQKIITIGSVSLTISTICLFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGPWPDGADLNLMPI

SEQ ID NO: 25388 - protein, 469 aa, Artificial Sequence
  neuraminidase__InfluenzaA__AHZ40761
MNPNQKIITIGSVSLTISTICFFMQIAILITTVTLHFKQYEFNSPPNNQVMLCEPTIIERNITEIVYLTNTTIEKELCPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCMAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKTDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKKETAVLWTSNSIVVFCGTSGTYGTGSWPDGADLNLMPI

SEQ ID NO: 25389 - protein, 469 aa, Artificial Sequence; identical to SEQ ID NO: 22146
  neuraminidase__InfluenzaA__AHZ40773

SEQ ID NO: 25390 - protein, 469 aa, Artificial Sequence; identical to SEQ ID NO: 16728
  neuraminidase__InfluenzaA__AHZ40785

SEQ ID NO: 25391 - protein, 469 aa, Artificial Sequence; identical to SEQ ID NO: 16728
  neuraminidase__InfluenzaA__AHZ40796

SEQ ID NO: 25392 - protein, 469 aa, Artificial Sequence; identical to SEQ ID NO: 16728
  neuraminidase__InfluenzaA__AHZ40807

SEQ ID NO: 25393 - protein, 469 aa, Artificial Sequence; identical to SEQ ID NO: 16728
  neuraminidase__InfluenzaA__AHZ40818

SEQ ID NO: 25394 - protein, 469 aa, Artificial Sequence; identical to SEQ ID NO: 16728
  neuraminidase__InfluenzaA__AHZ40829

SEQ ID NO: 25395 - protein, 469 aa, Artificial Sequence; identical to SEQ ID NO: 16728
  neuraminidase__InfluenzaA__AHZ40840

SEQ ID NO: 25396 - protein, 469 aa, Artificial Sequence; identical to SEQ ID NO: 16728
  neuraminidase__InfluenzaA__AHZ40851

SEQ ID NO: 25397 - protein, 469 aa, Artificial Sequence; identical to SEQ ID NO: 16728
  neuraminidase__InfluenzaA__AHZ40862

SEQ ID NO: 25398 - protein, 469 aa, Artificial Sequence; identical to SEQ ID NO: 16728
  neuraminidase__InfluenzaA__AHZ40873

SEQ ID NO: 25399 - protein, 469 aa, Artificial Sequence; identical to SEQ ID NO: 16728
  neuraminidase__InfluenzaA__AHZ40884

SEQ ID NO: 25400 - protein, 469 aa, Artificial Sequence; identical to SEQ ID NO: 16728
  neuraminidase__InfluenzaA__AHZ40895

SEQ ID NO: 25401 - protein, 469 aa, Artificial Sequence; identical to SEQ ID NO: 16728
  neuraminidase__InfluenzaA__AHZ40906

SEQ ID NO: 25402 - protein, 469 aa, Artificial Sequence; identical to SEQ ID NO: 16728
  neuraminidase__InfluenzaA__AHZ40917

SEQ ID NO: 25403 - protein, 469 aa, Artificial Sequence; identical to SEQ ID NO: 16728
  neuraminidase__InfluenzaA__AHZ40928

SEQ ID NO: 25404 - protein, 469 aa, Artificial Sequence; identical to SEQ ID NO: 16728
  neuraminidase__InfluenzaA__AHZ40939

SEQ ID NO: 25405 - protein, 469 aa, Artificial Sequence; identical to SEQ ID NO: 16728
  neuraminidase__InfluenzaA__AHZ40950

SEQ ID NO: 25406 - protein, 469 aa, Artificial Sequence; identical to SEQ ID NO: 16728
  neuraminidase__InfluenzaA__AHZ40961

SEQ ID NO: 25407 - protein, 469 aa, Artificial Sequence; identical to SEQ ID NO: 16728
  neuraminidase__InfluenzaA__AHZ40972

SEQ ID NO: 25408 - protein, 469 aa, Artificial Sequence; identical to SEQ ID NO: 16728
  neuraminidase__InfluenzaA__AHZ40983

SEQ ID NO: 25409 - protein, 469 aa, Artificial Sequence; identical to SEQ ID NO: 16728
  neuraminidase__InfluenzaA__AHZ40994

SEQ ID NO: 25410 - protein, 469 aa, Artificial Sequence; identical to SEQ ID NO: 16728
  neuraminidase__InfluenzaA__AHZ41005

SEQ ID NO: 25411 - protein, 469 aa, Artificial Sequence; identical to SEQ ID NO: 16728
  neuraminidase__InfluenzaA__AHZ41016

SEQ ID NO: 25412 - protein, 469 aa, Artificial Sequence; identical to SEQ ID NO: 16728
  neuraminidase__InfluenzaA__AHZ41027

SEQ ID NO: 25413 - protein, 469 aa, Artificial Sequence; identical to SEQ ID NO: 16728
  neuraminidase__InfluenzaA__AHZ41049

SEQ ID NO: 25414 - protein, 469 aa, Artificial Sequence; identical to SEQ ID NO: 16728
  neuraminidase__InfluenzaA__AHZ41060

SEQ ID NO: 25415 - protein, 469 aa, Artificial Sequence; identical to SEQ ID NO: 16728
  neuraminidase__InfluenzaA__AHZ41071

SEQ ID NO: 25416 - protein, 469 aa, Artificial Sequence; identical to SEQ ID NO: 16728
  neuraminidase__InfluenzaA__AHZ41082

SEQ ID NO: 25417 - protein, 469 aa, Artificial Sequence; identical to SEQ ID NO: 16728
  neuraminidase__InfluenzaA__AHZ41093

SEQ ID NO: 25418 - protein, 469 aa, Artificial Sequence; identical to SEQ ID NO: 16728
  neuraminidase__InfluenzaA__AHZ41104

SEQ ID NO: 25419 - protein, 469 aa, Artificial Sequence; identical to SEQ ID NO: 16728
  neuraminidase__InfluenzaA__AHZ41115

SEQ ID NO: 25420 - protein, 469 aa, Artificial Sequence; identical to SEQ ID NO: 16728
  neuraminidase__InfluenzaA__AHZ41126

SEQ ID NO: 25421 - protein, 469 aa, Artificial Sequence; identical to SEQ ID NO: 16728
  neuraminidase__InfluenzaA__AHZ41137

SEQ ID NO: 25422 - protein, 469 aa, Artificial Sequence; identical to SEQ ID NO: 16728
  neuraminidase__InfluenzaA__AHZ41148

SEQ ID NO: 25423 - protein, 469 aa, Artificial Sequence; identical to SEQ ID NO: 16728
  neuraminidase__InfluenzaA__AHZ41159

SEQ ID NO: 25424 - protein, 469 aa, Artificial Sequence; identical to SEQ ID NO: 16728
  neuraminidase__InfluenzaA__AHZ41170

SEQ ID NO: 25425 - protein, 469 aa, Artificial Sequence; identical to SEQ ID NO: 16728
  neuraminidase__InfluenzaA__AHZ41181

SEQ ID NO: 25426 - protein, 469 aa, Artificial Sequence; identical to SEQ ID NO: 16728
  neuraminidase__InfluenzaA__AHZ41205

SEQ ID NO: 25427 - protein, 469 aa, Artificial Sequence; identical to SEQ ID NO: 16728
  neuraminidase__InfluenzaA__AHZ41251

SEQ ID NO: 25428 - protein, 469 aa, Artificial Sequence; identical to SEQ ID NO: 16728
  neuraminidase__InfluenzaA__AHZ41266

SEQ ID NO: 25429 - protein, 469 aa, Artificial Sequence; identical to SEQ ID NO: 16728
  neuraminidase__InfluenzaA__AHZ41284

SEQ ID NO: 25430 - protein, 469 aa, Artificial Sequence; identical to SEQ ID NO: 16728
  neuraminidase__InfluenzaA__AHZ41295

SEQ ID NO: 25431 - protein, 469 aa, Artificial Sequence; identical to SEQ ID NO: 16728
  neuraminidase__InfluenzaA__AHZ41306

SEQ ID NO: 25432 - protein, 469 aa, Artificial Sequence; identical to SEQ ID NO: 16728
  neuraminidase__InfluenzaA__AHZ41317

SEQ ID NO: 25433 - protein, 469 aa, Artificial Sequence; identical to SEQ ID NO: 16728
  neuraminidase__InfluenzaA__AHZ41328

SEQ ID NO: 25434 - protein, 469 aa, Artificial Sequence; identical to SEQ ID NO: 16728
  neuraminidase__InfluenzaA__AHZ41339

SEQ ID NO: 25435 - protein, 469 aa, Artificial Sequence; identical to SEQ ID NO: 16728
  neuraminidase__InfluenzaA__AHZ41350

SEQ ID NO: 25436 - protein, 469 aa, Artificial Sequence; identical to SEQ ID NO: 16728
  neuraminidase__InfluenzaA__AHZ41369

SEQ ID NO: 25437 - protein, 469 aa, Artificial Sequence; identical to SEQ ID NO: 16728
  neuraminidase__InfluenzaA__AHZ41380

SEQ ID NO: 25438 - protein, 469 aa, Artificial Sequence; identical to SEQ ID NO: 16728
  neuraminidase__InfluenzaA__AHZ41391

SEQ ID NO: 25439 - protein, 469 aa, Artificial Sequence; identical to SEQ ID NO: 16728
  neuraminidase__InfluenzaA__AHZ41402

SEQ ID NO: 25440 - protein, 469 aa, Artificial Sequence; identical to SEQ ID NO: 16728
  neuraminidase__InfluenzaA__AHZ41413

SEQ ID NO: 25441 - protein, 469 aa, Artificial Sequence; identical to SEQ ID NO: 16728
  neuraminidase__InfluenzaA__AHZ41444

SEQ ID NO: 25442 - protein, 469 aa, Artificial Sequence; identical to SEQ ID NO: 16728
  neuraminidase__InfluenzaA__AHZ41455

SEQ ID NO: 25443 - protein, 469 aa, Artificial Sequence; identical to SEQ ID NO: 16728
  neuraminidase__InfluenzaA__AHZ41476

SEQ ID NO: 25444 - protein, 469 aa, Artificial Sequence; identical to SEQ ID NO: 16728
  neuraminidase__InfluenzaA__AHZ41487

SEQ ID NO: 25445 - protein, 469 aa, Artificial Sequence; identical to SEQ ID NO: 16728
  neuraminidase__InfluenzaA__AHZ41498

SEQ ID NO: 25446 - protein, 469 aa, Artificial Sequence; identical to SEQ ID NO: 16728
  neuraminidase__InfluenzaA__AHZ41509

SEQ ID NO: 25447 - protein, 469 aa, Artificial Sequence; identical to SEQ ID NO: 16728
  neuraminidase__InfluenzaA__AHZ41520

SEQ ID NO: 25448 - protein, 469 aa, Artificial Sequence; identical to SEQ ID NO: 16728
  neuraminidase__InfluenzaA__AHZ41531

SEQ ID NO: 25449 - protein, 469 aa, Artificial Sequence; identical to SEQ ID NO: 16728
  neuraminidase__InfluenzaA__AHZ41542

SEQ ID NO: 25450 - protein, 469 aa, Artificial Sequence; identical to SEQ ID NO: 16728
  neuraminidase__InfluenzaA__AHZ41553

SEQ ID NO: 25451 - protein, 469 aa, Artificial Sequence; identical to SEQ ID NO: 16728
  neuraminidase__InfluenzaA__AHZ41564

SEQ ID NO: 25452 - protein, 469 aa, Artificial Sequence; identical to SEQ ID NO: 16728
  neuraminidase__InfluenzaA__AHZ41586

SEQ ID NO: 25453 - protein, 469 aa, Artificial Sequence; identical to SEQ ID NO: 16728
  neuraminidase__InfluenzaA__AHZ41597

SEQ ID NO: 25454 - protein, 469 aa, Artificial Sequence; identical to SEQ ID NO: 16728
  neuraminidase__InfluenzaA__AHZ41608

SEQ ID NO: 25455 - protein, 469 aa, Artificial Sequence; identical to SEQ ID NO: 16728
  neuraminidase__InfluenzaA__AHZ41619

SEQ ID NO: 25456 - protein, 469 aa, Artificial Sequence; identical to SEQ ID NO: 16728
  neuraminidase__InfluenzaA__AHZ41630

SEQ ID NO: 25457 - protein, 469 aa, Artificial Sequence; identical to SEQ ID NO: 16728
  neuraminidase__InfluenzaA__AHZ41641

SEQ ID NO: 25458 - protein, 469 aa, Artificial Sequence; identical to SEQ ID NO: 16728
  neuraminidase__InfluenzaA__AHZ41652

SEQ ID NO: 25459 - protein, 469 aa, Artificial Sequence; identical to SEQ ID NO: 16728
  neuraminidase__InfluenzaA__AHZ41663

SEQ ID NO: 25460 - protein, 469 aa, Artificial Sequence; identical to SEQ ID NO: 16728
  neuraminidase__InfluenzaA__AHZ41674

SEQ ID NO: 25461 - protein, 469 aa, Artificial Sequence; identical to SEQ ID NO: 16728
  neuraminidase__InfluenzaA__AHZ41685

SEQ ID NO: 25462 - protein, 469 aa, Artificial Sequence; identical to SEQ ID NO: 16728
  neuraminidase__InfluenzaA__AHZ41696

SEQ ID NO: 25463 - protein, 469 aa, Artificial Sequence; identical to SEQ ID NO: 16728
  neuraminidase__InfluenzaA__AHZ41707

SEQ ID NO: 25464 - protein, 469 aa, Artificial Sequence; identical to SEQ ID NO: 16728
  neuraminidase__InfluenzaA__AHZ41718

SEQ ID NO: 25465 - protein, 469 aa, Artificial Sequence; identical to SEQ ID NO: 16728
  neuraminidase__InfluenzaA__AHZ41729

SEQ ID NO: 25466 - protein, 469 aa, Artificial Sequence; identical to SEQ ID NO: 16728
  neuraminidase__InfluenzaA__AHZ41740

SEQ ID NO: 25467 - protein, 469 aa, Artificial Sequence; identical to SEQ ID NO: 16728
  neuraminidase__InfluenzaA__AHZ41751

SEQ ID NO: 25468 - protein, 469 aa, Artificial Sequence; identical to SEQ ID NO: 16728
  neuraminidase__InfluenzaA__AHZ41762

SEQ ID NO: 25469 - protein, 469 aa, Artificial Sequence; identical to SEQ ID NO: 23389
  neuraminidase__InfluenzaA__AHZ42564

SEQ ID NO: 25470 - protein, 469 aa, Artificial Sequence; identical to SEQ ID NO: 22146
  neuraminidase__InfluenzaA__AHZ42575

SEQ ID NO: 25471 - protein, 469 aa, Artificial Sequence
  neuraminidase__InfluenzaA__AHZ42587
MNPNQKIITIGSVSLTISTICFFMQIAILITTVTLHFKQYEFNSPPNNQVMLCEPTIIERNITEIVYLTNTTIEKEMCPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25472 - protein, 470 aa, Artificial Sequence
  neuraminidase__InfluenzaA__AHZ42599
MNPNQKIITIGSVSLTISTICFFMQIAILITTVTLHFKQYEFNSPPKNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASEKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25473 - protein, 469 aa, Artificial Sequence; identical to SEQ ID NO: 24792
  neuraminidase__InfluenzaA__AHZ42611

SEQ ID NO: 25474 - protein, 469 aa, Artificial Sequence; identical to SEQ ID NO: 22146
  neuraminidase__InfluenzaA__AHZ42622

SEQ ID NO: 25475 - protein, 469 aa, Artificial Sequence; identical to SEQ ID NO: 25333
  neuraminidase__InfluenzaA__AHZ42634

SEQ ID NO: 25476 - protein, 469 aa, Artificial Sequence; identical to SEQ ID NO: 25376
  neuraminidase__InfluenzaA__AHZ42646

SEQ ID NO: 25477 - protein, 469 aa, Artificial Sequence; identical to SEQ ID NO: 22146
  neuraminidase__InfluenzaA__AHZ42657

SEQ ID NO: 25478 - protein, 469 aa, Artificial Sequence; identical to SEQ ID NO: 25093
  neuraminidase__InfluenzaA__AHZ42669

SEQ ID NO: 25479 - protein, 469 aa, Artificial Sequence; identical to SEQ ID NO: 22146
  neuraminidase__InfluenzaA__AHZ42681

SEQ ID NO: 25480 - protein, 469 aa, Artificial Sequence
  neuraminidase__InfluenzaA__AHZ42693
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGMDCIRPCFWVELIRGRPKENTIWTSGSIISFCGVNSDTVGWSWPDGAELPFTIDK

SEQ ID NO: 25481 - protein, 469 aa, Artificial Sequence; identical to SEQ ID NO: 22146
  neuraminidase__InfluenzaA__AHZ42704

SEQ ID NO: 25482 - protein, 469 aa, Artificial Sequence
  neuraminidase__InfluenzaA__AHZ42716
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKFQINRQVIVDRGDRSGYSGIFSVEGKSCINRCFYVELIRGRKEETEVLWTSNSIVVFCGTSGTYGTGSWPDGADLNLMPI

SEQ ID NO: 25483 - protein, 469 aa, Artificial Sequence; identical to SEQ ID NO: 22146
  neuraminidase__InfluenzaA__AHZ42728

SEQ ID NO: 25484 - protein, 469 aa, Artificial Sequence; identical to SEQ ID NO: 23389
  neuraminidase__InfluenzaA__AHZ42740

SEQ ID NO: 25485 - protein, 469 aa, Artificial Sequence; identical to SEQ ID NO: 23357
  neuraminidase__InfluenzaA__AHZ42751

SEQ ID NO: 25486 - protein, 469 aa, Artificial Sequence
  neuraminidase__InfluenzaA__AHZ42763
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVYTSTLSGSAQHVEECSCYPRYPGVRCVCRDNWKGSNRPIVDINIKDHSIVSRYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25487 - protein, 469 aa, Artificial Sequence; identical to SEQ ID NO: 23375
  neuraminidase__InfluenzaA__AHZ42775

SEQ ID NO: 25488 - protein, 469 aa, Artificial Sequence; identical to SEQ ID NO: 22146
  neuraminidase__InfluenzaA__AHZ42787

SEQ ID NO: 25489 - protein, 469 aa, Artificial Sequence
  neuraminidase__InfluenzaA__AHZ42799
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIIDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25490 - protein, 469 aa, Artificial Sequence
  neuraminidase__InfluenzaA__AHZ42811
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVGRGDRSGYSGIFSVEGKSCINRCFYVELIRGRKEETEVLWTSNSIVVFCGTSGTYGTGSWPDGADLNLMPI

SEQ ID NO: 25491 - protein, 469 aa, Artificial Sequence
  neuraminidase__InfluenzaA__AHZ42823
MNPNQKIITIGSVCMTIGMANLILQIGNIISIWISHSIQLGNQSQIETCNQSVITYENNTWVNQTYVNISNTNFAAEQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25492 - protein, 469 aa, Artificial Sequence
  neuraminidase__InfluenzaA__AHZ42834
MNPNQKIITIGSVSLTISTICFFMQTAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25493 - protein, 469 aa, Artificial Sequence; identical to SEQ ID NO: 22146
  neuraminidase__InfluenzaA__AHZ42846

SEQ ID NO: 25494 - protein, 469 aa, Artificial Sequence; identical to SEQ ID NO: 22146
  neuraminidase__InfluenzaA__AHZ42858

SEQ ID NO: 25495 - protein, 469 aa, Artificial Sequence; identical to SEQ ID NO: 22146
  neuraminidase__InfluenzaA__AHZ42870

SEQ ID NO: 25496 - protein, 469 aa, Artificial Sequence; identical to SEQ ID NO: 22146
  neuraminidase__InfluenzaA__AHZ42882

SEQ ID NO: 25497 - protein, 469 aa, Artificial Sequence
  neuraminidase__InfluenzaA__AHZ42894
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDKGDRSGYSGIFSVEGKSCINRCFYVELIRGRKEETEVLWTSNSIVVFCGTSGTYGTGSWPDGADLNLMPI

SEQ ID NO: 25498 - protein, 469 aa, Artificial Sequence; identical to SEQ ID NO: 22146
  neuraminidase__InfluenzaA__AHZ42906

SEQ ID NO: 25499 - protein, 469 aa, Artificial Sequence; identical to SEQ ID NO: 23375
  neuraminidase__InfluenzaA__AHZ42918

SEQ ID NO: 25500 - protein, 465 aa, Artificial Sequence; identical to SEQ ID NO: 23454
  neuraminidase__InfluenzaA__AHZ59750

SEQ ID NO: 25501 - protein, 465 aa, Artificial Sequence; identical to SEQ ID NO: 23454
  neuraminidase__InfluenzaA__AHZ59762

SEQ ID NO: 25502 - protein, 465 aa, Artificial Sequence; identical to SEQ ID NO: 23454
  neuraminidase__InfluenzaA__AHZ59774

SEQ ID NO: 25503 - protein, 465 aa, Artificial Sequence; identical to SEQ ID NO: 23454
  neuraminidase__InfluenzaA__AHZ59786

SEQ ID NO: 25504 - protein, 465 aa, Artificial Sequence; identical to SEQ ID NO: 23454
  neuraminidase__InfluenzaA__AHZ59798

SEQ ID NO: 25505 - protein, 465 aa, Artificial Sequence; identical to SEQ ID NO: 23454
  neuraminidase__InfluenzaA__AHZ59810

SEQ ID NO: 25506 - protein, 465 aa, Artificial Sequence; identical to SEQ ID NO: 23454
  neuraminidase__InfluenzaA__AHZ59822

SEQ ID NO: 25507 - protein, 465 aa, Artificial Sequence; identical to SEQ ID NO: 23454
  neuraminidase__InfluenzaA__AHZ59834

SEQ ID NO: 25508 - protein, 465 aa, Artificial Sequence; identical to SEQ ID NO: 23454
  neuraminidase__InfluenzaA__AHZ59846

SEQ ID NO: 25509 - protein, 465 aa, Artificial Sequence; identical to SEQ ID NO: 23454
  neuraminidase__InfluenzaA__AHZ59858

SEQ ID NO: 25510 - protein, 465 aa, Artificial Sequence; identical to SEQ ID NO: 23454
  neuraminidase__InfluenzaA__AHZ59870

SEQ ID NO: 25511 - protein, 465 aa, Artificial Sequence; identical to SEQ ID NO: 23454
  neuraminidase__InfluenzaA__AHZ59882

SEQ ID NO: 25512 - protein, 465 aa, Artificial Sequence; identical to SEQ ID NO: 23454
  neuraminidase__InfluenzaA__AHZ59918

SEQ ID NO: 25513 - protein, 465 aa, Artificial Sequence; identical to SEQ ID NO: 23454
  neuraminidase__InfluenzaA__AHZ59930

SEQ ID NO: 25514 - protein, 465 aa, Artificial Sequence; identical to SEQ ID NO: 23454
  neuraminidase__InfluenzaA__AHZ59942

SEQ ID NO: 25515 - protein, 465 aa, Artificial Sequence; identical to SEQ ID NO: 23454
  neuraminidase__InfluenzaA__AHZ59954

SEQ ID NO: 25516 - protein, 465 aa, Artificial Sequence; identical to SEQ ID NO: 23454
  neuraminidase__InfluenzaA__AHZ59966

SEQ ID NO: 25517 - protein, 465 aa, Artificial Sequence; identical to SEQ ID NO: 23454
  neuraminidase__InfluenzaA__AHZ59991

SEQ ID NO: 25518 - protein, 465 aa, Artificial Sequence; identical to SEQ ID NO: 23454
  neuraminidase__InfluenzaA__AHZ60003

SEQ ID NO: 25519 - protein, 465 aa, Artificial Sequence; identical to SEQ ID NO: 23454
  neuraminidase__InfluenzaA__AHZ60015

SEQ ID NO: 25520 - protein, 465 aa, Artificial Sequence; identical to SEQ ID NO: 23454
  neuraminidase__InfluenzaA__AHZ60027

SEQ ID NO: 25521 - protein, 465 aa, Artificial Sequence; identical to SEQ ID NO: 23454
  neuraminidase__InfluenzaA__AHZ60039

SEQ ID NO: 25522 - protein, 465 aa, Artificial Sequence; identical to SEQ ID NO: 23454
  neuraminidase__InfluenzaA__AHZ60051

SEQ ID NO: 25523 - protein, 465 aa, Artificial Sequence; identical to SEQ ID NO: 23454
  neuraminidase__InfluenzaA__AHZ60063

SEQ ID NO: 25524 - protein, 465 aa, Artificial Sequence; identical to SEQ ID NO: 23454
  neuraminidase__InfluenzaA__AHZ60075

SEQ ID NO: 25525 - protein, 465 aa, Artificial Sequence; identical to SEQ ID NO: 23454
  neuraminidase__InfluenzaA__AHZ60087

SEQ ID NO: 25526 - protein, 465 aa, Artificial Sequence; identical to SEQ ID NO: 23454
  neuraminidase__InfluenzaA__AHZ60099

SEQ ID NO: 25527 - protein, 469 aa, Artificial Sequence; identical to SEQ ID NO: 22146
  neuraminidase__InfluenzaA__AHZ60111

SEQ ID NO: 25528 - protein, 469 aa, Artificial Sequence; identical to SEQ ID NO: 16402
  neuraminidase__InfluenzaA__AIA26299

SEQ ID NO: 25529 - protein, 457 aa, Artificial Sequence
  neuraminidase__InfluenzaA__AIC64891
MNPNQKIITIGSVCMTIGMANLILQIGNIISIWISHSIQLGNQNQIETCNQSVITYENNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25530 - protein, 449 aa, Artificial Sequence
  neuraminidase__InfluenzaA__AID48084
MNPNKKIITIGSICMVTGMVSLMLQIGNLISIWVSHSIHTGNQHKAEPISNTNLLTEKTVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGAGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 25531 - protein, 469 aa, Artificial Sequence
  neuraminidase__InfluenzaA__AID70507
MNPNQKIITIGSVCTTIGMANLILQIGNIISIWISHSIQLGNQNQIETCNQSVITYENKTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCDPVSFNGANGVKGFSFKYGNGVWIGRTKSISSRNGFEMIWDPNGWTGTDNKFSIKQDIVGINEWSGYSGSFVQHPELTGLDCIRPCFWVELIRGRPKENTIWTSGSSISFCGVNSDTVGWFWPDGAELPFTIDK

SEQ ID NO: 25532 - protein, 469 aa, Artificial Sequence
  neuraminidase__InfluenzaA__AID70508
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPNNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25533 - protein, 469 aa, Artificial Sequence
  neuraminidase__InfluenzaA__AID70509
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSINSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25534 - protein, 469 aa, Artificial Sequence
  neuraminidase__InfluenzaA__AID70510
MNPNQKIITIGSVCITIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25535 - protein, 469 aa, Artificial Sequence
  neuraminidase__InfluenzaA__AID70511
MNPNQKIITMGSVWMTIGMANLILQSGNIISIWISHSIQLRNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25536 - protein, 469 aa, Artificial Sequence
  neuraminidase__InfluenzaA__AID70512
MNPNQKIITIGSVWMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMKAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIIGINEWSGYSGSFVQHPELTGLDCIRPCFWVELIRGRPKENTIWTSGSSISFCGVNSDTVGWSWPDGAELPFTIDK

SEQ ID NO: 25537 - protein, 469 aa, Artificial Sequence; identical to SEQ ID NO: 20257
  neuraminidase__InfluenzaA__AID70514

SEQ ID NO: 25538 - protein, 469 aa, Artificial Sequence
  neuraminidase__InfluenzaA__AID70515
MNPNQKIITIGSVCMTIGMANLILQIGNIISIWISHSIQLRNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYSNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25539 - protein, 469 aa, Artificial Sequence; identical to SEQ ID NO: 23158
  neuraminidase__InfluenzaA__AID70516

SEQ ID NO: 25540 - protein, 469 aa, Artificial Sequence
  neuraminidase__InfluenzaA__AID70517
MNPNQKIITIGSVCMTIGMANLTLQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPNDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25541 - protein, 469 aa, Artificial Sequence
  neuraminidase__InfluenzaA__AID70518
MNPNQKIITIGSVCMTIGMANLILQIGNIISIWISHSIQLRNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEIPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25542 - protein, 469 aa, Artificial Sequence
  neuraminidase__InfluenzaA__AID70519
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMKAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25543 - protein, 469 aa, Artificial Sequence
  neuraminidase__InfluenzaA__AID70520
MNPNQKIITIGSVCMTIGMANLILQIGNIISIWISHSIQLRNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSGTVGWSWPDGAELPFTIDK

SEQ ID NO: 25544 - protein, 469 aa, Artificial Sequence
  neuraminidase__InfluenzaA__AID70521
MNPNQKIITIGSVSLTISRICFFMQIAILINTVTLHFKQYEFNSPPNNQVMLCEPTIIERNITKIVYLTNTTIEKEICPKLAEYRSWSKPQCDITGFAPFSKDNSIRLSAGGDIWVTREPYVSCDPDKCFQFALGQGTTLNNVHSNDTVHDRTPYRTLLMNELGVPFHLGTKQVCIAWSSSSCHDGKAWLHVCITGDDKNATASIIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGFVGDTPRKPDRSSSSHCLDPNNEEGGHGVKGWAFDDGNDVWMGRTISEKSRLGYETFKVIGGWSNPNSKSQINRQVIVDRGNRSGYSGIFSVEGKSCINRCFYVELIRGRKDETEVLWTSNSIVVFCGTSGTYGTGSWPDGADINLMPI

SEQ ID NO: 25545 - protein, 469 aa, Artificial Sequence
  neuraminidase__InfluenzaA__AID70522
MNPNQKIITIGSVSLTISTICFFMQIAILITTVTLHFRQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 25546 - protein, 469 aa, Artificial Sequence
  neuraminidase__InfluenzaA__AID70523
MNPNQKIKTIGSVSLTNSTICIFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQFIVDRGNRSGYSGIFSVEGKSCINRCFYVELIRGRKEETEVLWTSNSIVVFCGTSGTYGTGSWPDGADLNLMPI

SEQ ID NO: 25547 - protein, 469 aa, Artificial Sequence
  neuraminidase__InfluenzaA__AID70524
MNPNQKIITIGAVWRTISTICFFMQIAFLITTVTLHFKQYEFNSPPNNQVMPCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 25548 - protein, 469 aa, Artificial Sequence
  neuraminidase__InfluenzaA__AID70525
MNPNQKIITIGSVSLTIWIICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNIMPI

SEQ ID NO: 25549 - protein, 469 aa, Artificial Sequence; identical to SEQ ID NO: 19518
  neuraminidase__InfluenzaA__AID70526

SEQ ID NO: 25550 - protein, 469 aa, Artificial Sequence
  neuraminidase__InfluenzaA__AID70527
MNPNQKIITIGSVSLTMWIICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 25551 - protein, 469 aa, Artificial Sequence
  neuraminidase__InfluenzaA__AID70528
MNPNQKIITIGSVSLSISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 25552 - protein, 469 aa, Artificial Sequence; identical to SEQ ID NO: 19518
  neuraminidase__InfluenzaA__AID70529

SEQ ID NO: 25553 - protein, 469 aa, Artificial Sequence
  neuraminidase__InfluenzaA__AID70530
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNIMPI

SEQ ID NO: 25554 - protein, 469 aa, Artificial Sequence; identical to SEQ ID NO: 19518
  neuraminidase__InfluenzaA__AID70531

SEQ ID NO: 25555 - protein, 469 aa, Artificial Sequence
  neuraminidase__InfluenzaA__AID70532
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETLKVIEGWSNPKSKLQINRQVIVDRGNRSGYYGIFSVEGKSCINRCFYVELIWGRKEEIEVLWTSNSKVVFCGTSGTYGTGSSPDGADLNFMPI

SEQ ID NO: 25556 - protein, 469 aa, Artificial Sequence
  neuraminidase__InfluenzaA__AID70533
MNPNQKIITIGSVSLAISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 25557 - protein, 469 aa, Artificial Sequence
  neuraminidase__InfluenzaA__AID70534
MNPNQKIITIGSVSLSIYIICFFMQIAILITTVTLHFKQYEFNSPPNNQAMPCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 25558 - protein, 469 aa, Artificial Sequence
  neuraminidase__InfluenzaA__AID70535
MNPNQKIITIGSVSLAMCTICFFMQIAILITTVTLHFKQYEFNSPPNNQAMPCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 25559 - protein, 469 aa, Artificial Sequence
  neuraminidase__InfluenzaA__AID70536
MNPNQKIITIGSVSLTISTVCFFMQIAILITTVTLHFKQYEFNSPPNNQVMLCEPTIIDRNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 25560 - protein, 469 aa, Artificial Sequence; identical to SEQ ID NO: 19518
  neuraminidase__InfluenzaA__AID70537

SEQ ID NO: 25561 - protein, 469 aa, Artificial Sequence
  neuraminidase__InfluenzaA__AID70538
MNPNQKKITIGAVSLTMCTVCIFMQIAILITTVTLHFRQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 25562 - protein, 469 aa, Artificial Sequence
  neuraminidase__InfluenzaA__AID70539
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLNPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 25563 - protein, 469 aa, Artificial Sequence; identical to SEQ ID NO: 19518
  neuraminidase__InfluenzaA__AID70540

SEQ ID NO: 25564 - protein, 469 aa, Artificial Sequence; identical to SEQ ID NO: 19518
  neuraminidase__InfluenzaA__AID70541

SEQ ID NO: 25565 - protein, 469 aa, Artificial Sequence
  neuraminidase__InfluenzaA__AID70633
MNPNQKIITIGSVCMTIGMANLILQIGNIISIWVSHSIQLGNQSQIEACNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNKFSIKQDIVGINEWSGYSGSFVQHPELTGLDCIRPCFWVELIRGRPEENTIWTSGSSISFCGVNSDTVGWSWPDGAELPFTIDK

SEQ ID NO: 25566 - protein, 465 aa, Artificial Sequence
  neuraminidase__InfluenzaA__AID70635
MNPKQKILCTSATAIIIGAIAVLIGIANLGLNIGLHLKPGCNCSHSQPETTNTSQTIINNYYNETNITNIQMEERTSRNFNNLTKGLCTINSWHIYGKDNAVRIGESSDVLVTREPYVSCDPDECRFYALSQGTTIRGKHSNGTIHDGSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKILKWESLTGTAKHIEECSCYGERTGITCTCRDNWQGSNRPVIQIDPVAMTHTSQYICSPVLTDNPRPNDPNIGKCNDPYPGNNNNGVKGFSYLDGANTWLGRTISTASRSGYEMLKVPNALTDDRSKPIQGQTIVLNADWSGYSGSFMDYWAEGDCYRACFYVELIRGRPKEDKVWWTSNSIVSMCSSTEFLGQWNWPDGAKIEYFL

SEQ ID NO: 25567 - protein, 466 aa, Artificial Sequence
  neuraminidase__InfluenzaA__AIG44695
MNPNQKITAIGSVSLIIAIICLLMQIAILTTTMTLHFRQNECSNPSNNQVMPCEPIIIERNTVHLNSTTIEREICPKVAEYKNWSKPQCQITGFAPFSKDNSIRLSASGDIWVTREPYVSCSLDKCYQFALGQGTTLKNKHSNGTTHDRTPHRTLLMNELGVPFHLGTKQVCIAWSSSSCYDGKAWLHVCVTGDDKNATASIIYDGMLVDSVGSWSKNILRTQESECVCINGTCAVVMTDGSASGKADTRVLFIREGKIINISPLSGSAQHVEECSCYPRYPEVRCVCRDNWKGSNRPILYINMADYSIESSYVCSGLVGDTPRNDDSSSSSNCRDPNNERGAPGVKGWAFDDGNDVWMGRTIKNGSRSGYETFRVVNGWTMANSKSQINRQVIVDSDGWSGYSGIFSVEGKKCINRCFYVELIRGRPQEPRVWWTSNSIIVFCGTSGTYGTGSWPDGANINFMPI

SEQ ID NO: 25568 - protein, 469 aa, Artificial Sequence
  neuraminidase__InfluenzaA__AIJ10793
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKAIEGWSNPKSKLQTNRQVIVDRGNRSGYSGIFSVEGKSCINRCFYVELIRGRKEETEVLWTSNSIVVFCGTSGTYGTGSWPDGADLNLMPI

SEQ ID NO: 25569 - protein, 469 aa, Artificial Sequence; identical to SEQ ID NO: 19518
  neuraminidase__InfluenzaA__AIJ10794

SEQ ID NO: 25570 - protein, 469 aa, Artificial Sequence; identical to SEQ ID NO: 21143
  neuraminidase__InfluenzaA__AIJ10795

SEQ ID NO: 25571 - protein, 469 aa, Artificial Sequence; identical to SEQ ID NO: 21143
  neuraminidase__InfluenzaA__AIJ10796

SEQ ID NO: 25572 - protein, 469 aa, Artificial Sequence
  neuraminidase__InfluenzaA__AIJ10797
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEDKSCINRCFYVELIRGRKEETEVLWTSNSIVVFCGTSGTYGTGSWPDGADLNLMPI

SEQ ID NO: 25573 - protein, 469 aa, Artificial Sequence
  neuraminidase__InfluenzaA__AIJ10798
MNPNQKIITIGSVSLTISTICFFMQIAILITTVTLHFKQYEFNSPPNNQVMLCEPTIIERNITEIVYLTNTTIEKEICPTLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 25574 - protein, 469 aa, Artificial Sequence; identical to SEQ ID NO: 21143
  neuraminidase__InfluenzaA__AIJ10799

SEQ ID NO: 25575 - protein, 469 aa, Artificial Sequence
  neuraminidase__InfluenzaA__AIJ10800
MNPNQKIITIGSVSLTISTICFFMQIAILITTVTLHFKQYEFNSSPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 25576 - protein, 469 aa, Artificial Sequence; identical to SEQ ID NO: 22146
  neuraminidase__InfluenzaA__AIJ10801

SEQ ID NO: 25577 - protein, 469 aa, Artificial Sequence; identical to SEQ ID NO: 22146
  neuraminidase__InfluenzaA__AIJ10803

SEQ ID NO: 25578 - protein, 469 aa, Artificial Sequence; identical to SEQ ID NO: 22146
  neuraminidase__InfluenzaA__AIJ10804

SEQ ID NO: 25579 - protein, 469 aa, Artificial Sequence; identical to SEQ ID NO: 22146
  neuraminidase__InfluenzaA__AIJ10805

SEQ ID NO: 25580 - protein, 469 aa, Artificial Sequence
  neuraminidase__InfluenzaA__AIJ10806
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSISHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25581 - protein, 469 aa, Artificial Sequence
  neuraminidase__InfluenzaA__AIJ10807
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREAYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25582 - protein, 469 aa, Artificial Sequence
  neuraminidase__InfluenzaA__AIJ10808
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEVLRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25583 - protein, 469 aa, Artificial Sequence; identical to SEQ ID NO: 22146
  neuraminidase__InfluenzaA__AIJ10809

SEQ ID NO: 25584 - protein, 469 aa, Artificial Sequence; identical to SEQ ID NO: 22146
  neuraminidase__InfluenzaA__AIJ10810

SEQ ID NO: 25585 - protein, 469 aa, Artificial Sequence
  neuraminidase__InfluenzaA__AIJ10812
MNPNQKIITIGSVSLTISTICFFMQIAILITTVTLHFKQYEFNSPPNNQVMLCEPTIMERNVTEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25586 - protein, 469 aa, Artificial Sequence
  neuraminidase__InfluenzaA__AIJ10813
MNPNQKIITIGSVSLTISTICFFMQIAILITTVTLHFKQYEFNSPPNNQVMLCEPTIMERNVTEIVYLTNTTIEKEICPKPAEYRNWSKPQCGITGFAPFSKDNSIRLSAGGDIWVTREPYVSCDPDKCYQFALGQGTTLNNVHSNNPVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25587 - protein, 469 aa, Artificial Sequence
  neuraminidase__InfluenzaA__AIJ10814
MNPNQKIITIGSVSLTISTICFFMQIAILITTVTLHFKQYEFNSPPNNQVMLCEPTIVERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDKGDRSGYSGIFSVEGKSCINRCFYVELIRGRKEETEVLWTSNSIVVFCGTSGTYGTGSWPDGADLNLMPI

SEQ ID NO: 25588 - protein, 469 aa, Artificial Sequence
  neuraminidase__InfluenzaA__AIJ10815
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEENEVLWTSNSIVVFCGTSGTYGTGSWPDGADLNLMPI

SEQ ID NO: 25589 - protein, 469 aa, Artificial Sequence
  neuraminidase__InfluenzaA__AIJ10816
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKGCINRCFYVELIRGRKEETEVLWTSNSIVVFCGTSGTYGTGSWPDGADLNLMPI

SEQ ID NO: 25590 - protein, 469 aa, Artificial Sequence; identical to SEQ ID NO: 22146
  neuraminidase__InfluenzaA__AIJ10817

SEQ ID NO: 25591 - protein, 469 aa, Artificial Sequence; identical to SEQ ID NO: 22146
  neuraminidase__InfluenzaA__AIJ10818

SEQ ID NO: 25592 - protein, 469 aa, Artificial Sequence
  neuraminidase__InfluenzaA__AIJ10819
MNPNQKIITIGSVSLTISTICFFMQIAILITTVALHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKANTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25593 - protein, 469 aa, Artificial Sequence; identical to SEQ ID NO: 22146
  neuraminidase__InfluenzaA__AIJ10820

SEQ ID NO: 25594 - protein, 469 aa, Artificial Sequence; identical to SEQ ID NO: 22146
  neuraminidase__InfluenzaA__AIJ10821

SEQ ID NO: 25595 - protein, 469 aa, Artificial Sequence
  neuraminidase__InfluenzaA__AIJ10822
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEENEVLWTSNSIVVFCGTSGTYGTGSWPDGADLNLMPI

SEQ ID NO: 25596 - protein, 469 aa, Artificial Sequence
  neuraminidase__InfluenzaA__AIJ10823
MNPNQKIITIGSVSLTISTICFFMQIAILITTVTLHFNQYEFNSPPNNQVMLCEPTIIERNITEIVYLTTTTIEKEICPKPAEYRNWSKPQCGITGFAPFSKDNSIRLSAGGDIWVTREPYVSCDPDKCYQFALGQGTTLNNVHSNNTVRDRTPFRTLLMNELGVPFHLGTKQVCIAWSSSSCHDGKAWLHVCITGDDKNATASFIYNGRLVDSVVSWSKEILRTQESECVCINGTCTVVMTDGSASGKAVTKILFIEEGKIVHTSTLSGSAQHVEECSCYPRYPGVRCVCRDNWKGSNRPIVDINIKDHSIVSGYVCSGLVGDTPRKNDSSSSSHCLNPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25597 - protein, 469 aa, Artificial Sequence
  neuraminidase__InfluenzaA__AIJ10824
MNPNQKIITIGSVSLTISTICFFMQIAILITTVTLHFKQYEFNSPPNNQVVLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25598 - protein, 469 aa, Artificial Sequence
  neuraminidase__InfluenzaA__AIJ10827
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSIEGKSCINRCFYVELIRGRKEETEVLWTSNSIVVFCGTSGTYGTGSWPDGADLNLMPI

SEQ ID NO: 25599 - protein, 469 aa, Artificial Sequence
  neuraminidase__InfluenzaA__AIJ10828
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSIEGKSCINRCFYVELIRGRKEETEVVWTSNSIVVFCGTSGTYGTGSWPDGADLNLMPI

SEQ ID NO: 25600 - protein, 469 aa, Artificial Sequence
  neuraminidase__InfluenzaA__AIJ10829
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDNCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGDHGVKGWAFDDGNDVWMGRTINETSRLGYETFKVIEGWSNPKSKLQINRQVIVDRGDRSGYSGIFSIEGKSCINRCFYVELIRGRKEETEVLWTSNSIVVFCGTSGTYGTGSWPDGADLNLMPI

SEQ ID NO: 25601 - protein, 469 aa, Artificial Sequence
  neuraminidase__InfluenzaA__AIJ10830
MNPNQKIITIGSVSLTISTICFFMQIAILITTVTLHFKQYEFNSPPNNQVMLCEPTIIERNITEIVYLTNTTIEKEICPKPAEYKNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSIEGKSCINRCFYVELIRGRKEETEVLWTSNSIVVFCGTSGTYGTGSWPDGADLNLMPI

SEQ ID NO: 25602 - protein, 469 aa, Artificial Sequence; identical to SEQ ID NO: 25598
  neuraminidase__InfluenzaA__AIJ10831

SEQ ID NO: 25603 - protein, 469 aa, Artificial Sequence; identical to SEQ ID NO: 25598
  neuraminidase__InfluenzaA__AIJ10832

SEQ ID NO: 25604 - protein, 469 aa, Artificial Sequence
  neuraminidase__InfluenzaA__AIJ10834
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSIESKSCINRCFYVELIRGRKEETEVLWTSNSIVVFCGTSGTYGTGSWPDGADLNLMPI

SEQ ID NO: 25605 - protein, 469 aa, Artificial Sequence
  neuraminidase__InfluenzaA__AIJ10835
MNPNQKIITIGSVSLTISTICFFMQIAILITTVTLHFKQYEFNSTPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSIEGKSCINRCFYVELIRGRKEETEVLWTSNSIVVFCGTSGTYGTGSWPDGADLNLMPI

SEQ ID NO: 25606 - protein, 469 aa, Artificial Sequence; identical to SEQ ID NO: 25598
  neuraminidase__InfluenzaA__AIJ10836

SEQ ID NO: 25607 - protein, 469 aa, Artificial Sequence
  neuraminidase__InfluenzaA__AIJ10837
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIIHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSIEGKSCINRCFYVELIRGRKEETEVLWTSNSIVVFCGTSGTYGTGSWPDGADLNLMPI

SEQ ID NO: 25608 - protein, 469 aa, Artificial Sequence; identical to SEQ ID NO: 25598
  neuraminidase__InfluenzaA__AIJ10838

SEQ ID NO: 25609 - protein, 469 aa, Artificial Sequence
  neuraminidase__InfluenzaA__AIJ10841
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGEADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSIEGKSCINRCFYVELIRGRKEETEVLWTSNSIVVFCGTSGTYGTGSWPDGADLNLMPI

SEQ ID NO: 25610 - protein, 469 aa, Artificial Sequence
  neuraminidase__InfluenzaA__AIJ10842
MNPNQKIITIGSVSLTISTICFFMQIAILITTVTLHFKQYEFNPPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSIEGKSCINRCFYVELIRGRKEETEVLWTSNSIVVFCGTSGTYGTGSWPDGADLNLMPI

SEQ ID NO: 25611 - protein, 469 aa, Artificial Sequence; identical to SEQ ID NO: 25598
  neuraminidase__InfluenzaA__AIJ10843

SEQ ID NO: 25612 - protein, 469 aa, Artificial Sequence
  neuraminidase__InfluenzaA__AIJ10844
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPFRTLLMNELGVPFHLGTKQVCIAWSSSSCHDGKAWLHVCITGDDKNATASFIYNGRLVDSVVSWSKEILRTQESECVCINGTCTVVMTDGSASGKAVTKILFIEEGKIVHTSTLSGSAQHVEECSCYPRYPGVRCVCRDNWKGSNRPIVDINIKDHSIVSGYVCSGLVGDTPRKNDSSSSGHCLDPNNEEGGHGVKGWAFDDGNDVWMGRTINETSRLGYETFKVIKGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25613 - protein, 469 aa, Artificial Sequence
  neuraminidase__InfluenzaA__AIJ10845
MNPNQKIITIGSVSLTISTICFFMQIAILITTVTLHFKQYEFNSPPNNQVMLCEPTIIERNITEIVYLTNTIIEKEICPKPAEYRNWSKPQCGITGFAPFSKDNSIRLSAGGDIWVTREPYVSCDPDKCYQFALGQGTTLNNVHSNNTVRDRTPFRTLLMNELGVPFHLGTKQVCIAWSSSSCHDGKAWLHVCITGDDKNATASFIYNGRLVDSVVSWSKEILRTQESECVCINGTCTVVMTDGSASGKAVTKILFIEEGKIVHTSTLSGSAQHVEECSCYPRYPGVRCVCRDNWKGSNRPIVDINIKDHSIVSGYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25614 - protein, 469 aa, Artificial Sequence
  neuraminidase__InfluenzaA__AIJ10847
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSFSSSHCLDPNNEEGGHGVKGWAFDDGNDVWMGRTINETSRLGYETFKVIEGWSNPKSKLQINRQVIVDRGDRSGYSGIFSIEGKSCINRCFYVELIRGRKEETEVLWTSNSIVVFCGTSGTYGTGSWPDGADLNLMPI

SEQ ID NO: 25615 - protein, 469 aa, Artificial Sequence; identical to SEQ ID NO: 25598
  neuraminidase__InfluenzaA__AIJ10848

SEQ ID NO: 25616 - protein, 469 aa, Artificial Sequence
  neuraminidase__InfluenzaA__AIJ10849
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPFRTLLMNELGVPFHLGTKQVCIAWSSSSCHDGKAWLHVCITGDDKNATASFIYNGRLVDSVVSWSKEILRTQESECVCINGTCTVVMTDGSASGKAVTKILFIEEGKIVHTSTLSGSAQHVEECSCYPRYPGVRCVCRDNWKGSNRPIVDINIKDHSIVSGYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25617 - protein, 469 aa, Artificial Sequence; identical to SEQ ID NO: 25616
  neuraminidase__InfluenzaA__AIJ10851

SEQ ID NO: 25618 - protein, 469 aa, Artificial Sequence; identical to SEQ ID NO: 25616
  neuraminidase__InfluenzaA__AIJ10852

SEQ ID NO: 25619 - protein, 469 aa, Artificial Sequence; identical to SEQ ID NO: 25612
  neuraminidase__InfluenzaA__AIJ10853

SEQ ID NO: 25620 - protein, 469 aa, Artificial Sequence; identical to SEQ ID NO: 25612
  neuraminidase__InfluenzaA__AIJ10854

SEQ ID NO: 25621 - protein, 469 aa, Artificial Sequence
  neuraminidase__InfluenzaA__AIJ10855
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPFRTLLMNELGVPFHLGTKQVCIAWSSSSCHDGKAWLHVCITGDDKNATASFIYNGRLVDSVVSWSKEILRTQESECVCINGTCTVVMTDGSASGKAVTKILFIEEGKIVHTSTLSGSAQHVEECSCYPRYPGVRCVCRDNWKGSNRPIVDINIKDHSIVSGYVCSGLVGDTPRKNDSSSSSHCLDPNNEEGDHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25622 - protein, 469 aa, Artificial Sequence
  neuraminidase__InfluenzaA__AIJ10856
MNPNKKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLKNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSFSSGHCLDPNNEEGGHGVKGWAFDDGNDVWMGRTINETSRLGYETFKVIEGWSNPKSKLQINRQVIVDRGDRSGYSGIFSIEGKSCINRCFYVELIRGRKEETEVLWTSNSIVVFCGTSGTYGTGSWPDGADLNLMPI

SEQ ID NO: 25623 - protein, 469 aa, Artificial Sequence; identical to SEQ ID NO: 25598
  neuraminidase__InfluenzaA__AIJ10857

SEQ ID NO: 25624 - protein, 469 aa, Artificial Sequence; identical to SEQ ID NO: 22146
  neuraminidase__InfluenzaA__AIJ29348

SEQ ID NO: 25625 - protein, 469 aa, Artificial Sequence; identical to SEQ ID NO: 22146
  neuraminidase__InfluenzaA__AIJ29350

SEQ ID NO: 25626 - protein, 469 aa, Artificial Sequence
  neuraminidase__InfluenzaA__AIJ29352
MNPNQKIITIGSVSLTISTICFFMQIAILITTVTLHFKQYEFNSPPNNQVMLCEPTIIERNITEIVYLTNTTIEKEICPKPAKYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25627 - protein, 469 aa, Artificial Sequence; identical to SEQ ID NO: 21143
  neuraminidase__InfluenzaA__AIJ29354

SEQ ID NO: 25628 - protein, 469 aa, Artificial Sequence; identical to SEQ ID NO: 22922
  neuraminidase__InfluenzaA__AIJ29356

SEQ ID NO: 25629 - protein, 469 aa, Artificial Sequence; identical to SEQ ID NO: 22922
  neuraminidase__InfluenzaA__AIJ29358

SEQ ID NO: 25630 - protein, 469 aa, Artificial Sequence
  neuraminidase__InfluenzaA__AIJ29360
MNPNQKIITIGSVSLTISTICFFMQIAILTTTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25631 - protein, 469 aa, Artificial Sequence; identical to SEQ ID NO: 22146
  neuraminidase__InfluenzaA__AIJ29362

SEQ ID NO: 25632 - protein, 469 aa, Artificial Sequence
  neuraminidase__InfluenzaA__AIL93626
MNPNQKIITIGSVCMTIGMANLILQIGNIISIWISHSIQLGNQSQIEACNQSVITYENNTYVNQTYVNISNTNFAAGRSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWKNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVLSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25633 - protein, 469 aa, Artificial Sequence
  neuraminidase__InfluenzaA__AIL93648
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGRIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINKQVIVDRGDRSGYSGIFSVEGKSCINRCFYVELIRGRKEETEVLWTSNSIVVFCGTSGTYGTGSWPDGADLNLMPI

SEQ ID NO: 25634 - protein, 469 aa, Artificial Sequence; identical to SEQ ID NO: 22146
  neuraminidase__InfluenzaA__AIL93660

SEQ ID NO: 25635 - protein, 469 aa, Artificial Sequence; identical to SEQ ID NO: 22146
  neuraminidase__InfluenzaA__AIL93672

SEQ ID NO: 25636 - protein, 469 aa, Artificial Sequence
  neuraminidase__InfluenzaA__AIL93684
MNPNQKIITIGSVCMTIGMANLILQIGNIISIWISHSIQLGNQSQIEACNQSVITYENNTWVNQTYVNISNTNSATGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWKNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVLSNGANGVKGFSFKYGNGVWIGRTKSISSRKGFEMIWDPNGWTGTDNNFSIKQDIVGINEWSGYSGSFVQHPELTGLDCIRPCFWIELIRGRPKENTIWTSGSSISFCGVNSDTVGWSWPDGAELPFTIDK

SEQ ID NO: 25637 - protein, 469 aa, Artificial Sequence
  neuraminidase__InfluenzaA__AIL93719
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINKQVIVDRGDRSGYSGIFSVEGKSCINRCFYVELIRGRKEETEVLWTSNSIVVFCGTSGTYGTGSWPDGADLNLMPI

SEQ ID NO: 25638 - protein, 469 aa, Artificial Sequence; identical to SEQ ID NO: 25637
  neuraminidase__InfluenzaA__AIL93743

SEQ ID NO: 25639 - protein, 469 aa, Artificial Sequence; identical to SEQ ID NO: 25637
  neuraminidase__InfluenzaA__AIL93755

SEQ ID NO: 25640 - protein, 469 aa, Artificial Sequence; identical to SEQ ID NO: 22146
  neuraminidase__InfluenzaA__AIL93767

SEQ ID NO: 25641 - protein, 469 aa, Artificial Sequence; identical to SEQ ID NO: 22146
  neuraminidase__InfluenzaA__AIL93779

SEQ ID NO: 25642 - protein, 469 aa, Artificial Sequence
  neuraminidase__InfluenzaA__AIL93791
MNPNQKIITIGSVSLTISTICFFMQIAILITTVTLHFKQYKFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTRTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINKQVIVDRGDRSGYSGIFSVEGKSCINRCFYVELIRGRKEETEVLWTSNSIVVFCGTSGTYGTGSWPDGADLNLMPI

SEQ ID NO: 25643 - protein, 469 aa, Artificial Sequence; identical to SEQ ID NO: 25637
  neuraminidase__InfluenzaA__AIL93803

SEQ ID NO: 25644 - protein, 469 aa, Artificial Sequence
  neuraminidase__InfluenzaA__AIL93815
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVYSYVCSGLVGDTPRKNDSSSSSHCLNPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25645 - protein, 469 aa, Artificial Sequence; identical to SEQ ID NO: 22146
  neuraminidase__InfluenzaA__AIL93827

SEQ ID NO: 25646 - protein, 469 aa, Artificial Sequence
  neuraminidase__InfluenzaA__AIL93839
MNPNQKIITIGSVCMTIGMANLILQIGNIISIWISHSIQLGNQSQIEACNQSVITYENNTWVNQTYVNISNTNFATGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWKNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25647 - protein, 469 aa, Artificial Sequence
  neuraminidase__InfluenzaA__AIL93850
MNPNQKIITIGSVCMTIGMANLILQIGNIISIWISHSIQLGNQSQIEACNQSVITYENNTWVNQTYVNISNTNFATGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWKNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGAKGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25648 - protein, 469 aa, Artificial Sequence; identical to SEQ ID NO: 25637
  neuraminidase__InfluenzaA__AIL93861

SEQ ID NO: 25649 - protein, 469 aa, Artificial Sequence
  neuraminidase__InfluenzaA__AIL93885
MNPNQKIITIGSVSLTISTICFFMQIAILITTVTLHFKQYEFDSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGVFSVEGKSCINRCFYVELIRGRKEETEVLWTSNSIVVFCGTSGTYGTGSWPDGADLNLMPI

SEQ ID NO: 25650 - protein, 469 aa, Artificial Sequence; identical to SEQ ID NO: 25637
  neuraminidase__InfluenzaA__AIL93897

SEQ ID NO: 25651 - protein, 469 aa, Artificial Sequence
  neuraminidase__InfluenzaA__AIL93909
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECVCVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25652 - protein, 469 aa, Artificial Sequence; identical to SEQ ID NO: 25637
  neuraminidase__InfluenzaA__AIL93920

SEQ ID NO: 25653 - protein, 469 aa, Artificial Sequence
  neuraminidase__InfluenzaA__AIL93943
MNPNQKIITIGSVCMTIGMANLILQIGNIISIWVSHSIQLGNQSQIETCNQSVITYENNTWVNQTYVNISNTNFAAGQSVVSVKLAGNSSLCPVSGWAIYSKDNSVRIGSKGDVFVIREPFISCSPSECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGIKEWSGYSGSFVQHPELTGLDCIRPCFWVELIRGRPEENTIWTSGSSISFCGVNSDTVGWSWPDGAELPFTIDK

SEQ ID NO: 25654 - protein, 469 aa, Artificial Sequence; identical to SEQ ID NO: 25637
  neuraminidase__InfluenzaA__AIL93954

SEQ ID NO: 25655 - protein, 469 aa, Artificial Sequence; identical to SEQ ID NO: 25637
  neuraminidase__InfluenzaA__AIL93966

SEQ ID NO: 25656 - protein, 469 aa, Artificial Sequence
  neuraminidase__InfluenzaA__AIL93978
MNPNQKIITIGSVSLTISTICLFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25657 - protein, 469 aa, Artificial Sequence; identical to SEQ ID NO: 25646
  neuraminidase__InfluenzaA__AIL93990

SEQ ID NO: 25658 - protein, 469 aa, Artificial Sequence; identical to SEQ ID NO: 22146
  neuraminidase__InfluenzaA__AIL94001

SEQ ID NO: 25659 - protein, 469 aa, Artificial Sequence; identical to SEQ ID NO: 25637
  neuraminidase__InfluenzaA__AIL94013

SEQ ID NO: 25660 - protein, 469 aa, Artificial Sequence; identical to SEQ ID NO: 25637
  neuraminidase__InfluenzaA__AIL94025

SEQ ID NO: 25661 - protein, 469 aa, Artificial Sequence; identical to SEQ ID NO: 25637
  neuraminidase__InfluenzaA__AIL94037

SEQ ID NO: 25662 - protein, 469 aa, Artificial Sequence; identical to SEQ ID NO: 25637
  neuraminidase__InfluenzaA__AIL94049

SEQ ID NO: 25663 - protein, 469 aa, Artificial Sequence; identical to SEQ ID NO: 25646
  neuraminidase__InfluenzaA__AIL94061

SEQ ID NO: 25664 - protein, 469 aa, Artificial Sequence
  neuraminidase__InfluenzaA__AIL94072
MNPNQKIITIGSVCMTIGMANLILQIGNIISIWISHSIQLGNQSQIEACNQSVITYENNTWVNQTYVNISNTNFATGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWKNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVLSNGANGVKGFSFKYGNGVWIGRTKSISSRKGFEMIWDPNGWTGTDNNFSIKQDIVGINEWSGYSGSFVQHPELTGLDCIRPCFWIELIRGRPKENTIWTSGSSISFCGVNSDTVGWSWPDGAELPFTIDK

SEQ ID NO: 25665 - protein, 469 aa, Artificial Sequence; identical to SEQ ID NO: 25646
  neuraminidase__InfluenzaA__AIL94083

SEQ ID NO: 25666 - protein, 469 aa, Artificial Sequence; identical to SEQ ID NO: 25637
  neuraminidase__InfluenzaA__AIL94238

SEQ ID NO: 25667 - protein, 469 aa, Artificial Sequence
  neuraminidase__InfluenzaA__AIL94250
MNPNQKIITIGSVCMTIGMANLILQIGNIISIWISHSIQLGNQSQIEACNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWKNNILRTQESECACVNGSCFTIMTDGPNDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25668 - protein, 469 aa, Artificial Sequence; identical to SEQ ID NO: 22146
  neuraminidase__InfluenzaA__AIL94261

SEQ ID NO: 25669 - protein, 469 aa, Artificial Sequence; identical to SEQ ID NO: 22146
  neuraminidase__InfluenzaA__AIL94273

SEQ ID NO: 25670 - protein, 469 aa, Artificial Sequence; identical to SEQ ID NO: 22146
  neuraminidase__InfluenzaA__AIL94285

SEQ ID NO: 25671 - protein, 469 aa, Artificial Sequence
  neuraminidase__InfluenzaA__AIL94297
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTRTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINKQVIVDRGDRSGYSGIFSVEGKSCINRCFYVELIRGRKEETEVLWTSNSIVVFCGTSGTYGTGSWPDGADLNLMPI

SEQ ID NO: 25672 - protein, 469 aa, Artificial Sequence; identical to SEQ ID NO: 25637
  neuraminidase__InfluenzaA__AIL94309

SEQ ID NO: 25673 - protein, 469 aa, Artificial Sequence; identical to SEQ ID NO: 25656
  neuraminidase__InfluenzaA__AIL94321

SEQ ID NO: 25674 - protein, 469 aa, Artificial Sequence; identical to SEQ ID NO: 22146
  neuraminidase__InfluenzaA__AIL94368

SEQ ID NO: 25675 - protein, 469 aa, Artificial Sequence
  neuraminidase__InfluenzaA__AIL94380
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPVVDINIKDHSIVSSYVCSGLVGDTPRKNDSSSSSHCLDPNNEEGGHGVKGWAFDDGNDVWMGRTINETSRLGYETFKVIEGWSNPKSKLQINKQVIVDRGDRSGYSGIFSVEGKSCINRCFYVELIRGRKEETEVLWTSNSIVVFCGTSGTYGTGSWPDGADLNLMPI

SEQ ID NO: 25676 - protein, 469 aa, Artificial Sequence
  neuraminidase__InfluenzaA__AIL94392
MNPNQKIITIGSVCMTIGMANLILQIGNIISIWISHSIQLGNQSQIEACNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWKNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25677 - protein, 469 aa, Artificial Sequence
  neuraminidase__InfluenzaA__AIL94403
MNPNQKIITIGSVCMTIGMANLILQIGNIISIWISHSIQLGNQSQIEACNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWKNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCDPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25678 - protein, 469 aa, Artificial Sequence; identical to SEQ ID NO: 22146
  neuraminidase__InfluenzaA__AIL94426

SEQ ID NO: 25679 - protein, 469 aa, Artificial Sequence
  neuraminidase__InfluenzaA__AIL94438
MNPNQKIITIGSVCMTIGMANLILQIGNIISIWISHSIQLGNQSQIEACNQSVITYENNTWVNQTYVNISNTNFATGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWKNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSVSSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25680 - protein, 469 aa, Artificial Sequence
  neuraminidase__InfluenzaA__AIL94449
MNPNQKIITIGSVSLTISTICFFMQIAILITTVTLHFKQYEFNSPPNNQVMLCEPTIIERNITEIVYLTNTTIEKEICPKPAKYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVYSYVCSGLVGDTPRKNDSSSSSHCLNPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25681 - protein, 469 aa, Artificial Sequence; identical to SEQ ID NO: 25675
  neuraminidase__InfluenzaA__AIL94461

SEQ ID NO: 25682 - protein, 469 aa, Artificial Sequence
  neuraminidase__InfluenzaA__AIL94473
MNPNQKIITIGSVCMTIGMANLILQIGNIISIWVGHSIQLGNQSQIETCNQSVITYENNTWVNQTYVNISNTNFAAGQSVVPVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNTPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGIKEWSGYSGSFVQHPELTGLDCIRPCFWVELIRGRPEENTIWTSGSSISFCGVNSDIVGWSWPDGAELPFTIDK

SEQ ID NO: 25683 - protein, 469 aa, Artificial Sequence; identical to SEQ ID NO: 24736
  neuraminidase__InfluenzaA__AIL94484

SEQ ID NO: 25684 - protein, 469 aa, Artificial Sequence; identical to SEQ ID NO: 25646
  neuraminidase__InfluenzaA__AIL94507

SEQ ID NO: 25685 - protein, 469 aa, Artificial Sequence
  neuraminidase__InfluenzaA__AIL94518
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINKQVIVDRGDRSGYSGIFSVEGKSCINRCFYVELIRGRKEETEVLWTSNSIVVFCGTSGTYGTGSWPDGADLSLMPI

SEQ ID NO: 25686 - protein, 469 aa, Artificial Sequence
  neuraminidase__InfluenzaA__AIL94530
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLNPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25687 - protein, 469 aa, Artificial Sequence; identical to SEQ ID NO: 25676
  neuraminidase__InfluenzaA__AIL94542

SEQ ID NO: 25688 - protein, 469 aa, Artificial Sequence; identical to SEQ ID NO: 25646
  neuraminidase__InfluenzaA__AIL94553

SEQ ID NO: 25689 - protein, 469 aa, Artificial Sequence; identical to SEQ ID NO: 25637
  neuraminidase__InfluenzaA__AIL94564

SEQ ID NO: 25690 - protein, 469 aa, Artificial Sequence; identical to SEQ ID NO: 25646
  neuraminidase__InfluenzaA__AIL94576

SEQ ID NO: 25691 - protein, 469 aa, Artificial Sequence
  neuraminidase__InfluenzaA__AIL94587
MNPNQKIITIGSVCMTIGMANLILQIGNIISIWISHSIQLGNQSQIEACNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWKNNILRTQESECACVNGSCFTIMTDGPSDGQASYKIFRIEKGKIVKSVEMDAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWNGTDNNFSIKQDIVGINEWSGYSGSFVQHPELTGLDCIRPCFWVELIRGRPKENTIWTGGSSISFCGVNSDTVGWSWPDGAELPFTIDK

SEQ ID NO: 25692 - protein, 469 aa, Artificial Sequence; identical to SEQ ID NO: 25676
  neuraminidase__InfluenzaA__AIL94598

SEQ ID NO: 25693 - protein, 469 aa, Artificial Sequence
  neuraminidase__InfluenzaA__AIL94609
MNPNQKIITIGSVSLTISTICLFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMSELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPLYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25694 - protein, 469 aa, Artificial Sequence
  neuraminidase__InfluenzaA__AIL94621
MNPNQKIITIGSVCMTIGMANLILQIGNIISIWISHSIQLGNQSQIEACNQSVITYENNTWVNQTYVNISNTNFAAGQSVVPVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWKNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNDFSIKQDIVGINEWSGYSGSFVQHPELTGLDCIRPCFWVELIRGRPKENTIWTSGSSISFCGVNSDTVGWSWPDGAELPFTIDK

SEQ ID NO: 25695 - protein, 469 aa, Artificial Sequence; identical to SEQ ID NO: 25646
  neuraminidase__InfluenzaA__AIL94632

SEQ ID NO: 25696 - protein, 469 aa, Artificial Sequence; identical to SEQ ID NO: 22146
  neuraminidase__InfluenzaA__AIL94643

SEQ ID NO: 25697 - protein, 469 aa, Artificial Sequence
  neuraminidase__InfluenzaA__AIL94655
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25698 - protein, 469 aa, Artificial Sequence
  neuraminidase__InfluenzaA__AIL94677
MNPNQKIITIGSVCMTIGMANLILQIGNIISIWISHSIQLGNQSQIEACNQSVITYENNTWVNQTYVNISNTNFAAGQSVVPVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWKNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25699 - protein, 469 aa, Artificial Sequence; identical to SEQ ID NO: 25637
  neuraminidase__InfluenzaA__AIL94688

SEQ ID NO: 25700 - protein, 469 aa, Artificial Sequence
  neuraminidase__InfluenzaA__AIL94700
MNPNQKIITIGSVSLTISTICFFMQIAILITIVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHISTLSGSAQHVEECSCYPRYPGVRCVCRDNWKGSNRPIVDINIEDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25701 - protein, 469 aa, Artificial Sequence; identical to SEQ ID NO: 25646
  neuraminidase__InfluenzaA__AIL94712

SEQ ID NO: 25702 - protein, 469 aa, Artificial Sequence; identical to SEQ ID NO: 25676
  neuraminidase__InfluenzaA__AIL94723

SEQ ID NO: 25703 - protein, 469 aa, Artificial Sequence
  neuraminidase__InfluenzaA__AIL94734
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNEHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHISTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25704 - protein, 469 aa, Artificial Sequence; identical to SEQ ID NO: 25646
  neuraminidase__InfluenzaA__AIL94746

SEQ ID NO: 25705 - protein, 469 aa, Artificial Sequence; identical to SEQ ID NO: 25676
  neuraminidase__InfluenzaA__AIL94757

SEQ ID NO: 25706 - protein, 469 aa, Artificial Sequence; identical to SEQ ID NO: 25637
  neuraminidase__InfluenzaA__AIL94768

SEQ ID NO: 25707 - protein, 469 aa, Artificial Sequence; identical to SEQ ID NO: 22146
  neuraminidase__InfluenzaA__AIL94780

SEQ ID NO: 25708 - protein, 469 aa, Artificial Sequence; identical to SEQ ID NO: 25676
  neuraminidase__InfluenzaA__AIL94803

SEQ ID NO: 25709 - protein, 469 aa, Artificial Sequence; identical to SEQ ID NO: 25656
  neuraminidase__InfluenzaA__AIL94814

SEQ ID NO: 25710 - protein, 469 aa, Artificial Sequence
  neuraminidase__InfluenzaA__AIL94826
MNPNQKIITIGSVSLTISTICFFMQIAILITTVTLHFKQYEFNSLPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTARDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLNPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25711 - protein, 469 aa, Artificial Sequence
  neuraminidase__InfluenzaA__AIL94850
MNPNQKIITIGSVSLTISTICFFMQIAILITTVTLHFKQYEFNSPPNNQVMLFEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIKEGKIVHTSTLSGSAQHVEECSCYPRYPGVRCVCRDNWKGSNRPIVDINIKDHSIVSSYVCSGLVGDTPRKNDSSSSSHCLDPNSEEGGHGVKGWAFDDGNDVWMGRTISEKSRLGYETFKVIEGWSNPKSKFQINRQVIVDRGNRSGYSGIFSVEGKSCINRCFYVELIRGRKEETEVLWTSNSIVVFCGTSGTYGTGSWPDGADLNLMPI

SEQ ID NO: 25712 - protein, 469 aa, Artificial Sequence; identical to SEQ ID NO: 19410
  neuraminidase__InfluenzaA__AIL94862

SEQ ID NO: 25713 - protein, 469 aa, Artificial Sequence; identical to SEQ ID NO: 19410
  neuraminidase__InfluenzaA__AIL94874

SEQ ID NO: 25714 - protein, 469 aa, Artificial Sequence
  neuraminidase__InfluenzaA__AIL94886
MNPNQKIITIGSVCMTIGMANLMLQIGNIISIWISHSIQLGNKNQIETCNQSVITYENNTWVNQTYVNISNTNFAAGQSVVSVKIAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDDGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPHDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25715 - protein, 469 aa, Artificial Sequence; identical to SEQ ID NO: 22922
  neuraminidase__InfluenzaA__AIL94897

SEQ ID NO: 25716 - protein, 469 aa, Artificial Sequence; identical to SEQ ID NO: 25710
  neuraminidase__InfluenzaA__AIL94909

SEQ ID NO: 25717 - protein, 469 aa, Artificial Sequence; identical to SEQ ID NO: 22146
  neuraminidase__InfluenzaA__AIL94921

SEQ ID NO: 25718 - protein, 469 aa, Artificial Sequence; identical to SEQ ID NO: 22146
  neuraminidase__InfluenzaA__AIL94933

SEQ ID NO: 25719 - protein, 469 aa, Artificial Sequence; identical to SEQ ID NO: 25637
  neuraminidase__InfluenzaA__AIL94945

SEQ ID NO: 25720 - protein, 469 aa, Artificial Sequence
  neuraminidase__InfluenzaA__AIL94957
MNPNQKIITIGSVCMTIGMANLILQIGNIISIWISHSIQLGNQSQIEACNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWKNNILRTQESECACVNGSCFTIMTDGPSDGQASYKIFRIEKGKIVKSVEMDAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWNGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25721 - protein, 469 aa, Artificial Sequence; identical to SEQ ID NO: 25710
  neuraminidase__InfluenzaA__AIL94968

SEQ ID NO: 25722 - protein, 469 aa, Artificial Sequence
  neuraminidase__InfluenzaA__AIM55840
MNPNQKIITIGSVCMTIGMANLILQIGNIISIWISHSIQVGNQSQIEICNQSVITYENNTWVNQTYVNISNTNFAAGQPVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNDILRTQESECACVNGSCFTIMTDGPSDGQASYKIFRIEKGKIVKSVEMNAPNYHFEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25723 - protein, 469 aa, Artificial Sequence
  neuraminidase__InfluenzaA__AIM55851
MNPNQKIITIGSVCMTIGMANLILQIGNIISIWVSHSIQLGNQSQIETCNQSVITYENNTWVNQTYVNISNTNFAAGQSVVPVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGRIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNKFSIKQDIVGINEWSGYSGSFVQHPELTGLDCIRPCFWVELIRGRPEENTIWTSGSSISFCGVKSDTVGWSWPDGAELPFTIDK

SEQ ID NO: 25724 - protein, 469 aa, Artificial Sequence
  neuraminidase__InfluenzaA__AIM55862
MNPNQKIITIGSVCMTIGMANLILQIGNIISIWVSHSIQLGNQSQIETCNQSVITYENNTWVNQTYVNISNTNFAAGQSVVPVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFKIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWNGTDNNFSIKQDIVGIKEWSGYSGSFVQHPELTGLDCIRPCFWVELIRGRPEENTIWTSGSSISFCGVNSDTVGWSWPDGAELPFTIDK

SEQ ID NO: 25725 - protein, 469 aa, Artificial Sequence
  neuraminidase__InfluenzaA__AIM55873
MNPNQKIITIGSVCMTIGMANLILQIGNIISIWVSHSIQLGNQSQIETCNQSVITYENNTWVNQTYVNISNTNFAAGQSVVPVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGIKEWSGYSGSFVQHPELTGLDCIRPCFWVELIRGRPEENTIWTSGSSISFCGVNSDTVGWSWPDGAELPFTIDK

SEQ ID NO: 25726 - protein, 469 aa, Artificial Sequence; identical to SEQ ID NO: 25725
  neuraminidase__InfluenzaA__AIM55884

SEQ ID NO: 25727 - protein, 469 aa, Artificial Sequence; identical to SEQ ID NO: 25725
  neuraminidase__InfluenzaA__AIM55918

SEQ ID NO: 25728 - protein, 469 aa, Artificial Sequence
  neuraminidase__InfluenzaA__AIM55929
MNPNQKIITIGSVCMTIGMANLILQIGNIISIWVSHSIQLGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPTGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGIKEWSGYSGSFVQHPELTGLDCIRPCFWVELIRGRPEENTIWTSGSSISFCGVNSDTVGWSWPDGAELPFTIDK

SEQ ID NO: 25729 - protein, 469 aa, Artificial Sequence
  neuraminidase__InfluenzaA__AIM55940
MNPNQKIITIGSVCMTIGMANLILQIGNIISIWVSHSIQLGNQSQIETCNQSVITYENNTWVNQTYVNISSTNFAAGQSVVPVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGIKEWSGYSGSFVQHPELTGLDCIRPCFWVELIRGRPEENTIWTSGSSISFCGVNSDTVGWSWPDGAELPFTIDK

SEQ ID NO: 25730 - protein, 469 aa, Artificial Sequence
  neuraminidase__InfluenzaA__AIM55965
MNPNQKIITIGSVCMTIGMANLILQIGNIISIWVSHSIQLGNQSQIETCNQSVITYENNTWVNQTYVNISNTNFAAGQSVVPVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGIKEWSGYSGSFVQHPELTGLDCIRPCFWVELIRGRPEENTIWTSGSSISFCGVNSDAVGWSWPDGAELPFTIDK

SEQ ID NO: 25731 - protein, 469 aa, Artificial Sequence
  neuraminidase__InfluenzaA__AIM55976
MNPNQKIITIGSVCMTIGMANLILQIGNIISIWVSHSIQLGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGIKEWSGYSGSFVQHPELTGLDCIRPCFWVELIRGRPEENTIWTSGSSISFCGVNSDTVGWSWPDGAELPFTIDK

SEQ ID NO: 25732 - protein, 469 aa, Artificial Sequence
  neuraminidase__InfluenzaA__AIM55987
MNPNQKIITIGSVCMTIGMANLILQIGNIISIWVSHSIQLGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPTGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGIKEWSGYSGSFVQHPELTGLDCIRPCFWVELIRGRPEENTIWTSGSSISFCGVNSDTVDWSWPDGAELPFTIDK

SEQ ID NO: 25733 - protein, 469 aa, Artificial Sequence
  neuraminidase__InfluenzaA__AIM55998
MNPNQKIITIGSVCMTIGMANLILQIGNTISIWVSHSIQLGNQSQIETCNQSVITYENNTWVNQTYVNISNTNFAAGQSVVPVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNKFSIKQDIVGINEWSGYSGSFVQHPELTGLDCIRPCFWVELIRGRPEENTIWTSGSSISFCGVKSDTVGWSWPDGAELPFTIDK

SEQ ID NO: 25734 - protein, 469 aa, Artificial Sequence; identical to SEQ ID NO: 25731
  neuraminidase__InfluenzaA__AIM56009

SEQ ID NO: 25735 - protein, 469 aa, Artificial Sequence; identical to SEQ ID NO: 25731
  neuraminidase__InfluenzaA__AIM56020

SEQ ID NO: 25736 - protein, 469 aa, Artificial Sequence; identical to SEQ ID NO: 25731
  neuraminidase__InfluenzaA__AIM56031

SEQ ID NO: 25737 - protein, 469 aa, Artificial Sequence
  neuraminidase__InfluenzaA__AIM56042
MNPNQKIITIGSVCMTIGMANLILQIGNIISIWVSHSIQLGNQSQIETCNQSVITYENNTWVNQTYVNISNTNFAAGQSVVPVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSNGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGIKEWSGYSGSFVQHPELTGLDCIRPCFWVELIRGRPEENTIWTSGSSISFCGVNSDTVGWSWPDGAELPFTIDK

SEQ ID NO: 25738 - protein, 469 aa, Artificial Sequence
  neuraminidase__InfluenzaA__AIM56053
MNPNQKIITIGSVCMTIGMANLILQIGNIISIWVSHSIQLGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDEQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGIKEWSGYSGSFVQHPELTGLDCIRPCFWVELIRGRPEENTIWTSGSSISFCGVNSDTVGWSWPDGAELPFTIDK

SEQ ID NO: 25739 - protein, 469 aa, Artificial Sequence
  neuraminidase__InfluenzaA__AIM56064
MNPNQKIITIGSVCMTIGMANLILQIGNIISIWVSHSIQLGNQSQIETCNQSVITYENNTWVNQTYVNISNTNFAAGQSVVPVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGIKEWSGYSGSFVQHPELTGLDCIRPCFWVELVRGRPEENTIWTSGSSISFCGVNSDTVGWSWPDGAELPFTIDK

SEQ ID NO: 25740 - protein, 469 aa, Artificial Sequence
  neuraminidase__InfluenzaA__AIM56086
MNPNQKIITIGSVCMTIGMANLILQIGNIISIWVSHSIQLGNQSHIETCNQSVITYENNTWVNQTYVNISNTNFAAGQSVVPVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVTSNGANGVKGFSFKYGNGVWIGRTKSISSRKGFEMIWDPNGWTGTDNNFSIKQDIIGIKEWSGYSGSFVQHPELTGLDCIRPCFWVELIRGRPEENTIWTSGSSISFCGVNSDTVGWSWPDGAELPFTIDK

SEQ ID NO: 25741 - protein, 469 aa, Artificial Sequence
  neuraminidase__InfluenzaA__AIM56097
MNPNQKIITIGSVCMTIGMANLILQIGNIISIWVSHSIQLGNQSQIETCNQSVITYENNTWVNQTYVNISNTNFAAEQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGIKEWSGYSGSFVQHPELTGLDCIRPCFWVELIRGRPEENTIWTSGSSISFCGVNSDTVGWSWPDGAELPFTIDK

SEQ ID NO: 25742 - protein, 469 aa, Artificial Sequence
  neuraminidase__InfluenzaA__AIM56108
MNPNQKIITIGSVCMTIGMANLILQIGNIISIWVSHSIQLGNQSQIETCNQSVITYENNTWINQTYVNISNTNFAAGQSVVPVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGIKEWSGYSGSFVQHPELTGLDCIRPCFWVELIRGRPEENTIWTSGSSISFCGVNSDTVGWSWPDGAELPFTIDK

SEQ ID NO: 25743 - protein, 469 aa, Artificial Sequence
  neuraminidase__InfluenzaA__AIM56119
MNPNQKIITIGSVCMTIGMANLILQIGNIISIWVSHSIQIGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNKFSIKQDIVGINEWSGYSGSFVQHPELTGLDCIRPCFWVELIRGRPEENTIWTSGSSISFCGVNSDTVGWSWPDGAELPFTIDK

SEQ ID NO: 25744 - protein, 469 aa, Artificial Sequence
  neuraminidase__InfluenzaA__AIM56130
MNPNQKIITIGSVCMTIGMANLILQIGNIISIWVSHSIQLGNQSQIETCNQSVITYENNTWVNQTYVNISNTNFAAGQSVVPVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNKFSIKQDIVGINEWSGYSGSFVQHPELTGLDCIRPCFWVELIRGRPEENTIWTSGSSISFCGVKSDTVGWSWPDGAELPFTIDK

SEQ ID NO: 25745 - protein, 469 aa, Artificial Sequence
  neuraminidase__InfluenzaA__AIM56141
MNPNQKIITIGSVCMTIGMANLILQIGNIISIWVSHSIQLGNQSQIETCNQSVIIYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGIKEWSGYSGSFVQHPELTGLDCIRPCFWVELIRGRPEENTIWTSGSSISFCGVNSDTVGWSWPDGAELPFTIDK

SEQ ID NO: 25746 - protein, 469 aa, Artificial Sequence; identical to SEQ ID NO: 25731
  neuraminidase__InfluenzaA__AIM56152

SEQ ID NO: 25747 - protein, 469 aa, Artificial Sequence
  neuraminidase__InfluenzaA__AIM56163
MNPNQKIITIGSVCMTIGMANLILQIGNIISIWVSHSIQLGNQSHIETCNQSVITYENNTWVNQTYVNISNTNFAAGQSVVPVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVTSNGANGVKGFSFKYGNGVWIGRTKSISSRKGFEMIWDPNGWTGTDNNFSIKQDIVGIKEWSGYSGSFVQHPELTGLDCIRPCFWVELIRGRPEENTIWTSGSSISFCGVNSDTVGWSWPDGAELPFTIDK

SEQ ID NO: 25748 - protein, 469 aa, Artificial Sequence
  neuraminidase__InfluenzaA__AIM56174
MNPNQKIITIGSVCMTIGMANLILQIGNIISIWVSHSIQLGNQSQIETCNQSVITYENNTWVNQTYVNISNTNFAAGQSVVPVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGIKEWSGYSGSFVQHPELTGLDCIRPCFWVELIRGRPEENTIWTSGSSISFCGVNSDTVGWSWPDGAELPFTVDK

SEQ ID NO: 25749 - protein, 469 aa, Artificial Sequence; identical to SEQ ID NO: 25744
  neuraminidase__InfluenzaA__AIM56185

SEQ ID NO: 25750 - protein, 469 aa, Artificial Sequence; identical to SEQ ID NO: 25743
  neuraminidase__InfluenzaA__AIM56196

SEQ ID NO: 25751 - protein, 469 aa, Artificial Sequence; identical to SEQ ID NO: 25725
  neuraminidase__InfluenzaA__AIM56207

SEQ ID NO: 25752 - protein, 469 aa, Artificial Sequence
  neuraminidase__InfluenzaA__AIM56229
MNPNQKIITIGSVCMTIGMANLILQIGNTISIWVSHSIQIGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGHASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNKFSIKQDIVGINEWSGYSGSFVQHPELTGLDCIRPCFWVELIRGRPEENTIWTSGSSISFCGVNSDTVGWSWPDGAELPFTIDK

SEQ ID NO: 25753 - protein, 469 aa, Artificial Sequence
  neuraminidase__InfluenzaA__AIM56240
MNPNQKIITIGSVCMTIGMANLILQIGNIISIWISHSIQVGNQSQIETCNQSVITYENNTWVNQTYVNISNTNFAAGQPVVSVKLAGNSSLCSVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNDILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25754 - protein, 469 aa, Artificial Sequence
  neuraminidase__InfluenzaA__AIM56251
MNPNQKIITIGSVCMTIGMANLILQIGNIISIWVSHSIQLGNQSHIETCNQSVITYENNTWVNQTYVNISNTNFAAGQSVVPVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGIKEWSGYSGSFVQHPELTGLDCIRPCFWVELIRGRPEENTIWTSGSSISFCGVNSDTVGWSWPDGAELPFTIDK

SEQ ID NO: 25755 - protein, 469 aa, Artificial Sequence; identical to SEQ ID NO: 25754
  neuraminidase__InfluenzaA__AIM56262

SEQ ID NO: 25756 - protein, 469 aa, Artificial Sequence; identical to SEQ ID NO: 25725
  neuraminidase__InfluenzaA__AIM56273

SEQ ID NO: 25757 - protein, 469 aa, Artificial Sequence
  neuraminidase__InfluenzaA__AIM56284
MNPNQKIITIGSVCITIGMANLILQIGNIISIWVSHSIQIGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNKFSIKQDVVGINEWSGYSGSFVQHPELTGLDCIRPCFWVELIRGRPEENTIWTSGSSISFCGVNSDTVGWSWPDGAELPFTIDK

SEQ ID NO: 25758 - protein, 469 aa, Artificial Sequence; identical to SEQ ID NO: 25725
  neuraminidase__InfluenzaA__AIM56295

SEQ ID NO: 25759 - protein, 469 aa, Artificial Sequence; identical to SEQ ID NO: 25725
  neuraminidase__InfluenzaA__AIM56306

SEQ ID NO: 25760 - protein, 469 aa, Artificial Sequence; identical to SEQ ID NO: 25725
  neuraminidase__InfluenzaA__AIM56317

SEQ ID NO: 25761 - protein, 469 aa, Artificial Sequence; identical to SEQ ID NO: 25744
  neuraminidase__InfluenzaA__AIM56339

SEQ ID NO: 25762 - protein, 469 aa, Artificial Sequence
  neuraminidase__InfluenzaA__AIM56350
MNPNQKIITIGSVCMTIGMANLILQIGNIISIWVSHSIQLGNQSQIETCNQSVITYENNTWVNQTYVNISNTNFAAGQSVVPVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGIKEWSGYSGSFVQHPELTGLDCIRPCFWVELIRGRPEENTIWTSGSSISFCGINSDTVGWSWPDGAELPFTIDK

SEQ ID NO: 25763 - protein, 469 aa, Artificial Sequence; identical to SEQ ID NO: 25754
  neuraminidase__InfluenzaA__AIM56361

SEQ ID NO: 25764 - protein, 469 aa, Artificial Sequence; identical to SEQ ID NO: 25725
  neuraminidase__InfluenzaA__AIM56372

SEQ ID NO: 25765 - protein, 469 aa, Artificial Sequence; identical to SEQ ID NO: 25754
  neuraminidase__InfluenzaA__AIM56383

SEQ ID NO: 25766 - protein, 469 aa, Artificial Sequence
  neuraminidase__InfluenzaA__AIM56394
MNPNQKIITIGSVCMTIGMANLILQIGNIISIWVSHSIQIGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNKFSIKQDIVGINEWSGYSGSFVQHPELTGLDCIRPCFWVELIRGRPEENTIWTSGSSISFCGVNSDTVGWSWPDGAELPFTIDK

SEQ ID NO: 25767 - protein, 469 aa, Artificial Sequence; identical to SEQ ID NO: 25743
  neuraminidase__InfluenzaA__AIM56405

SEQ ID NO: 25768 - protein, 469 aa, Artificial Sequence
  neuraminidase__InfluenzaA__AIM56416
MNPNQKIITIGSVCMTIGMANLILQIGNIISIWVSHSIQLGNQSHIETCNQSVITYENNTWVNQTYVNISNINFAAGQSVVPVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVTSNGANGVKGFSFKYGNGVWIGRTKSISSRKGFEMIWDPNGWTGTDNNFSIKQDIVGIKEWSGYSGSFVQHPELTGLDCIRPCFWVELIRGRPEENTIWTSGSSISFCGVNSDTVGWSWPDGAELPFTIDK

SEQ ID NO: 25769 - protein, 469 aa, Artificial Sequence; identical to SEQ ID NO: 25743
  neuraminidase__InfluenzaA__AIM56428

SEQ ID NO: 25770 - protein, 469 aa, Artificial Sequence; identical to SEQ ID NO: 25725
  neuraminidase__InfluenzaA__AIM56439

SEQ ID NO: 25771 - protein, 469 aa, Artificial Sequence
  neuraminidase__InfluenzaA__AIM56450
MNPNQKIITIGSVCMTIGMANLILQIGNIISIWISHSIQVGNQSQIETCNQSVITYENNTWVNQTYVNISNTNFAAGQPVVSVKLAGNSSLCPVSGWAIYSKDNSVRVGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNDILRTQESECACVNGSCFTIMTDGPSDGQASYKIFRIEKGKIVKSVEMNAPNYHYEECSCYPDSSEITCVCRDNWHGSNRPWVSFNQNLEYKIGYICSGIFGDNPRPNDKTGSCGPVSSNGANGVKGFSFKYGNGVWIGRTKSISSRKGFEMIWDPNGWTGTDNNFSVKQDIVGINEWSGYSGSFVQHPELTGLDCIRPCFWVELIRGRPKENTIWTSGSSISFCGVNSDTVGWSWPDGAELPFTIDK

SEQ ID NO: 25772 - protein, 469 aa, Artificial Sequence
  neuraminidase__InfluenzaA__AIM56461
MNPNQKIITIGSVCMTIGMANLILQIGNIISIWVSHSIQIGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWKNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNKFSIKQDIVGVNEWSGYSGSFVQHPELTGLDCIRPCFWVELIRGRPEENTIWTSGSSISFCGVNSDTVGWSWPDGAELPFTIDK

SEQ ID NO: 25773 - protein, 469 aa, Artificial Sequence
  neuraminidase__InfluenzaA__AIM56472
MNPNQKIITIGSVCMTIGMANLILQIGNIISIWVSHSIQIGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACNDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNKFSIKQDIVGINEWSGYSGSFVQHPELTGLDCIRPCFWVELIRGRPEENTIWTSGSSISFCGVNSDTVGWSWPDGAELPFTIDK

SEQ ID NO: 25774 - protein, 469 aa, Artificial Sequence; identical to SEQ ID NO: 25731
  neuraminidase__InfluenzaA__AIM56483

SEQ ID NO: 25775 - protein, 469 aa, Artificial Sequence; identical to SEQ ID NO: 25754
  neuraminidase__InfluenzaA__AIM56494

SEQ ID NO: 25776 - protein, 469 aa, Artificial Sequence; identical to SEQ ID NO: 25744
  neuraminidase__InfluenzaA__AIM56505

SEQ ID NO: 25777 - protein, 469 aa, Artificial Sequence; identical to SEQ ID NO: 25743
  neuraminidase__InfluenzaA__AIM56516

SEQ ID NO: 25778 - protein, 469 aa, Artificial Sequence
  neuraminidase__InfluenzaA__AIM56527
MNPNQKIITIGSVCMTIGMANLILQIGNIISIWVSHSIQLGNQSQIETCNQSVITYENNTWVNQTYVNISNTNFAAEQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVLGDNPRPNDKTGSCGPVSSNGANGVKGFSFKYGNGVWIGRTKSISSRKGFEMVWDPNGWTGTDNNFSIKQDIVGIKEWSGYSGSFVQHPELTGLDCIRPCFWVELIRGRPEENTIWTSGSSISFCGVNSDTVGWSWPDGAELPFTIDK

SEQ ID NO: 25779 - protein, 469 aa, Artificial Sequence; identical to SEQ ID NO: 25725
  neuraminidase__InfluenzaA__AIM56538

SEQ ID NO: 25780 - protein, 469 aa, Artificial Sequence
  neuraminidase__InfluenzaA__AIM56549
MNPNQKIITIGSVCMTIGMANLILQIGNIISIWVSHSIQIGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEVTCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNKFSIKQDIVGINEWSGYSGSFVQHPELTGLDCIRPCFWVELIRGRPEENTIWTSGSSISFCGVNSDTVGWSWPDGAELPFTIDK

SEQ ID NO: 25781 - protein, 469 aa, Artificial Sequence
  neuraminidase__InfluenzaA__AIM56560
MNPNQKIITIGSVCMTIGMANLILQIGNIISIWVSHSIQLGNQSHIETCNQSVITYENNTWVNQTYVNISNTNFAAGQSVVPVKLAGNSSLCPVSGWAIHSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVTSNGANGVKGFSFKYGNGVWIGRTKSISSRKGFEMIWDPNGWTGTDNNFSIKQDIVGIKEWSGYSGSFVQHPELTGLDCIRPCFWVELIRGRPEENTIWTSGSSISFCGVNSDTVGWSWPDGAELPFTIDK

SEQ ID NO: 25782 - protein, 469 aa, Artificial Sequence; identical to SEQ ID NO: 25731
  neuraminidase__InfluenzaA__AIM56571

SEQ ID NO: 25783 - protein, 469 aa, Artificial Sequence
  neuraminidase__InfluenzaA__AIM56582
MNPNQKIITIGSVCITIGMANLILQIGNIISIWVSHSIQLGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGIKEWSGYSGSFVQHPELTGLDCIRPCFWVELIRGRPEENTIWTSGSSISFCGVNSDTVGWSWPDGAELPFTIDK

SEQ ID NO: 25784 - protein, 469 aa, Artificial Sequence
  neuraminidase__InfluenzaA__AIM56593
MNPNQKIITIGSVCMTIGMANLILQIGNIISIWVSHSIQLGNQSQIETCNQSVITYENNTWVNQTYVNISNTNFAAEQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVLGDNPRPNDKTGSCGPVSSNGANGVKGFSFKYGNGVWIGRTKSISSRKGFEMIWDPNGWTETDNNFSIKQDIVGIKEWSGYSGSFVQHPELTGLDCIRPCFWVELIRGRPEENTIWTSGSSISFCGVNSDTVGWSWPDGAELPFTIDK

SEQ ID NO: 25785 - protein, 469 aa, Artificial Sequence
  neuraminidase__InfluenzaA__AIM56604
MNPNQKIITIGSVCMTIGMANLILQIGNIISIWVSHSIQIGNQSQIETCNQSVITYENNTWVNQTYVNISNINFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNKFSIKQDIVGINEWSGYSGSFVQHPELTGLDCIRPCFWVELIRGRPEENTIWTSGSSISFCGVNSDTVGWSWPDGAELPFTIDK

SEQ ID NO: 25786 - protein, 469 aa, Artificial Sequence
  neuraminidase__InfluenzaA__AIM56615
MNPNQKIITIGSVCMTIGMANLILQIGNIISIWVSHSIQIGNQSQIETCNQSVITYENNTWVNQTYVDISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYSNGVWIGRTKSISSRKGFEMIWDPNGWTGTDNKFSIKQDIVGINEWSGYSGSFVQHPELTGLDCIRPCFWVELIRGRPEENTIWTSGSSISFCGVNSDTVGWSWPDGAELPFTIDK

SEQ ID NO: 25787 - protein, 469 aa, Artificial Sequence; identical to SEQ ID NO: 25780
  neuraminidase__InfluenzaA__AIM56626

SEQ ID NO: 25788 - protein, 469 aa, Artificial Sequence; identical to SEQ ID NO: 25725
  neuraminidase__InfluenzaA__AIM56637

SEQ ID NO: 25789 - protein, 469 aa, Artificial Sequence; identical to SEQ ID NO: 25731
  neuraminidase__InfluenzaA__AIM56648

SEQ ID NO: 25790 - protein, 469 aa, Artificial Sequence
  neuraminidase__InfluenzaA__AIM56659
MNPNQKIITIGSVCMTIGMANLILQIGNIISIWVSHSIQLGNQSHIETCNQSVITYENNTWVNQTYVNISNTNFAAGQSVVPVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKIGSCGPVSSNGANGVKGFSFKYGNGVWIGRTKSISSRKGFEMIWDPNGWTGTDNNFSIKQDIVGIKEWSGYSGSFVQHPELTGLDCIRPCFWVELIRGRPEEKTIWTSGSSISFCGVNSDTVGWSWPDGAELPFTIDK

SEQ ID NO: 25791 - protein, 469 aa, Artificial Sequence
  neuraminidase__InfluenzaA__AIM56670
MNPNQKIITIGSVCMTIGMANLILQIGNTISIWVSHSIQIGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNKFSIKQDIVGINEWSGYSGSFVQHPELTGLDCIRPCFWVELIRGRPEENTIWTSGSSISFCGVNSDTVGWSWPDGAELPFTIDK

SEQ ID NO: 25792 - protein, 469 aa, Artificial Sequence; identical to SEQ ID NO: 25743
  neuraminidase__InfluenzaA__AIM56703

SEQ ID NO: 25793 - protein, 469 aa, Artificial Sequence
  neuraminidase__InfluenzaA__AIM56714
MNPNQKIITIGSVCMTIGMANLILQIGNIISIWVSHSIQIGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVPSNGANGVKGFSFKYGNGVWIGRTKSISSRKGFEMIWDPNGWTGTDNKFSIKQDIVGINEWSGYSGSFVQHPELTGLDCIRPCFWVELIRGRPEENTIWTSGSSISFCGVNSDTVGWSWPDGAELPFTIDK

SEQ ID NO: 25794 - protein, 469 aa, Artificial Sequence
  neuraminidase__InfluenzaA__AIM56725
MNPNQKIITIGSVCMTIGMANLILQIGNIISIWVSHSIQIGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEVTCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNKFSIKQDIVGINEWSGYSGSFVQHPELTGLDCIRPCFWVELIRGRPEENTIWTSGSSISFCGVNSDTVGWSWPDGAELPFTIDK

SEQ ID NO: 25795 - protein, 469 aa, Artificial Sequence; identical to SEQ ID NO: 25743
  neuraminidase__InfluenzaA__AIM56736

SEQ ID NO: 25796 - protein, 469 aa, Artificial Sequence
  neuraminidase__InfluenzaA__AIM56747
MNPNQKIITIGSVCMTIGMANLILQIGNIISIWVSHSIQIGNQSQIETCNQSVITYENNTWVNQTYVNISNTNFAAGQSVVSVKLAGNSSLCPVSGWAIYSKDNSVRIGSKGDVFVIREPFISCSSLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNKFSIKQDIVGINEWSGYSGSFVQHPELTGLDCIRPCFWVELIRGRPEENTIWTSGSSISFCGVNSDTVGWSWPDGAELPFTIDK

SEQ ID NO: 25797 - protein, 469 aa, Artificial Sequence; identical to SEQ ID NO: 25780
  neuraminidase__InfluenzaA__AIM56758

SEQ ID NO: 25798 - protein, 469 aa, Artificial Sequence; identical to SEQ ID NO: 25743
  neuraminidase__InfluenzaA__AIM56769

SEQ ID NO: 25799 - protein, 469 aa, Artificial Sequence
  neuraminidase__InfluenzaA__AIM56780
MNPNQKIITIGSVCMTIGMANLILQIGNIISIWVSHSIQLGNQSQIGTCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIIKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNKFSIKQDIVGIHEWSGYSGSFVQHPELTGLDCIRPCFWVELIRGRPEENTIWTSGSSISFCGVNSDTVGWSWPDGAELPFTIDK

SEQ ID NO: 25800 - protein, 469 aa, Artificial Sequence
  neuraminidase__InfluenzaA__AIM56791
MNPNQKIITIGSVCMTIGMANLILQIGNIISIWVSHSIQLGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGISWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGIKEWSGYSGSFVQHPELTGLDCIRPCFWVELIRGRPEENTIWTSGSSISFCGVNSDTVGWSWPDGAELPFTIDK

SEQ ID NO: 25801 - protein, 469 aa, Artificial Sequence
  neuraminidase__InfluenzaA__AIM56813
MNPNQKIITIGSVCMTIGMANLILQIGNIISIWVSHSIQIGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSKFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNKFSIKQDIVGINEWSGYSGSFVQHPELTGLDCIRPCFWVELIRGRPEENTIWTSGSSISFCGVNSDTVGWSWPDGAELPFTIDK

SEQ ID NO: 25802 - protein, 469 aa, Artificial Sequence
  neuraminidase__InfluenzaA__AIM56824
MNPNQKIITIGSVCMTIGMANLILQIGNIISIWVSHSIQIGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVPSNGANGVKGFSFKYSNGVWIGRTKSISSRKGFEMIWDPNGWTGTDNKFSIKQDIVGINEWSGYSGSFVQHPELTGLDCIRPCFWVELIRGRPEENTIWTSGSSISFCGVNSDTVGWSWPDGAELPFTIDK

SEQ ID NO: 25803 - protein, 465 aa, Artificial Sequence
  neuraminidase__InfluenzaA__AIN76385
MNPNQKILCTSATAIIIGAIAVLIGIANLGLNIGLHLKPGCNCSHSQPGTTNTSQTIINNYYNETNITNIQMEERTSRNFNSLTKGLCTINSWHIYGKDNAVRIGESSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGICPIVFTDGSATGPADTRIYYFKEGKILKWESLTGTAKHIEECSCYGERTGITCTCKDNWQGSNRPVIQIDPVAMTHTSQYICSPVLTDTPRPNDPNIGKCNDPYPGNNNNGVKGFSYLDGANTWLGRTISTASRSGYEMLKVPNALTDDRSKPIQGQTIVLNADWSGYSGSFMDYWAEGDCYRACFYVELIRGRPKEDKVWWTSNSIVSMCSSTEFLGQWNWPDGARIEYFL

SEQ ID NO: 25804 - protein, 469 aa, Artificial Sequence; identical to SEQ ID NO: 14087
  neuraminidase__InfluenzaA__AIP93105

SEQ ID NO: 25805 - protein, 469 aa, Artificial Sequence
  neuraminidase__InfluenzaA__AIP93117
MNPNQKIITIGSVSLTIATVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTISKDLRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 25806 - protein, 469 aa, Artificial Sequence
  neuraminidase__InfluenzaA__AIR93973
MNPNQKIITIGSVCMTIGMANLILQIGNIISIWISHSIQLGSRNQIEACNQSVITYENNTWVNQTYVNISNTNFAAGQSVVPVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECVCVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTETDNNFSIKQDIVGINEWSGYSGSFVQHPELTGLDCIRPCFWVELIRGRPKENTIWTSGSSISFCGVNSNTVGWSWPDGAELPFTIDK

SEQ ID NO: 25807 - protein, 469 aa, Artificial Sequence
  neuraminidase__InfluenzaA__AIR93984
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEINAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLGCIRPCFWVELIRGRPKENTIWTSGSSISFCGVNSDTVGWSWPDGAELPFTIDK

SEQ ID NO: 25808 - protein, 469 aa, Artificial Sequence
  neuraminidase__InfluenzaA__AIR93995
MNPNQKIIIIGSVCMTIGMANLILQIGNIISIWISHSIQLGNQNQIETCNQSVITYENNTWVNQTYVNISNTNFAAGQSVVPVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWKNNILRTQESECVCVNGSCFTVMTDGPSNGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRNGFEMIWDPNGWTGTDNNFSIKQDIIGINEWSGYSGSFVQHPELTGMDCIRPCFWVELIRGRPKENTIWTSGSSISFCGVNSDTVGWSWPDGAELPFTIDK

SEQ ID NO: 25809 - protein, 466 aa, Artificial Sequence
  neuraminidase__InfluenzaA__AIR94118
MNPNQKIIAIGSVSLIIAIICLLMQIAILTTTMTLHFRQNECNNSSNNQVMPCEPIIIERNTVHLNSTTIEREICPKVAEYKNWSKPQCQITGFAPFSKDNSIRLSAGGDIWVTREPYVSCSLDKCYQFALGQGTTLKNKHSNGTTHDRTPHRTLLMNELGVPFHLGTKQVCIAWSSSSCYDGKAWLHICVTGDDKNATASIIYNGMLVDSIGSWSKNILRTQESECVCINGTCAVVMTDGSASGKADTRVLFIKEGKIINISPLSGSAQHVEECSCYPRYPEVRCVCRDNWKGSNRPILYINMADYSIESSYVCSGLVGDTPRNDDSSSSSNCKDPNSERGAPGVKGWAFDDGNDVWMGRTIKNGSRSGYETFRVVNGWTVANSKSQVNRQVIVDSDDWSGYSGIFSVEGKKCINRCFYVELIRGRPQEPRVWWTSNSIIVFCGTSGTYGTGSWPDGANINFMPI

SEQ ID NO: 25810 - protein, 469 aa, Artificial Sequence
  neuraminidase__InfluenzaA__AIT38335
MNPNQKIITIGSVSLTIATICFLMQIAILVTTVTLHFKQYECNSPPTNQVMLCEPTIIERNITEIVYLTNTTIEKEICPKLVEYRNWSKPQCKITGFAPFSKDNSIRLSAGGDIWVTREPYVSCDPDKCYQFALGQGTTLNNRHSNDTVHDRTPYRTLLMNELGIPFHLGTKQVCIAWSSSSCHDGKAWLHVCVTGHDENATASFIYDGRLVDSIVSWSKRILRTQESECVCIDGTCTVVMTDGSASGRADTRILFIKEGKIIHISQLSGSAQHVEECSCYPRYPGVRCVCRDNWKGSNRPIVDINVKDYSINSSYVCSGLVGDTPRKNDSFSSSYCLNPNNEEGGHGVKGWAFDDGDDVWMGRTINEKLRSGYETFKVIKGWSKPNSKLQINRQVIVDRGNRSGYSGIFSVEGKGCINRCFYVELIRGRKQETEVWWTSNSIVVFCGTSGTYGTGSWPDGANINLMPI

SEQ ID NO: 25811 - protein, 469 aa, Artificial Sequence
  neuraminidase__InfluenzaA__AIT38346
MNPNQKIITIGSISLTIATICFLLQVAILVTTVTLHFKQFECNPTPNNQVMLCEPTVIERNITKIVYLTNTTVEKEICPKPAEYRNWSKPQCKITGFAPFSKDNSIRLSAGGDIWVTREPYVSCAPNKCYQFALGQGTTLNNRHSNDTVHDRTPYRTLLMNELGIPFHLGTKQVCIAWSSSSCHDGKAWLHVCVTGHDKNATASFIYDGRLVDSIGSWSKNILRTQESECVCINGTCTVVMTDGSASGRADTKILFIKEGKIIHISQLSGSAQHVEECSCYPRYPGVRCVCRDNWKGSNRPIVDINVRDYSIVSSYVCSGLVGDTPRKNDSFSSSHCLNPNNEEGGHGVKGWAFDDGDDVWMGRTISEKLRSGYETFKVIKGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 25812 - protein, 469 aa, Artificial Sequence
  neuraminidase__InfluenzaA__AIT38361
MNPNQKIITIGSISLTIATICFLMQVAILVTTVTLHFKQYECNSTPNNQVMLCEPTVIERNITKIVYLTNTTVVKEVCPKPAEYRNWSKPQCKITGFAPFSKDNSIRLSAGGDIWVTREPYVSCAPNKCYQFALGQGTTLNNRHSNDTVHDRTPYRTLLMNELGIPFHLGTKQVCIAWSSSSCYDGKAWLHVCVTGHDKNATASFIYDGRLVDSIGSWSKNILRTQESECVCINGTCTVVMTDGSASGRADTKILFIKEGKIIHISQLSGSAQHVEECSCYPRYPGVRCVCRDNWKGSNRPIVDINMRDYSIVSSYVCSGLVGDTPRENDSFSSSHCLNPNNEEGGHGVKGWAFDDGDDVWMGRTISEKLRSGYETFKVIKGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 25813 - protein, 469 aa, Artificial Sequence
  neuraminidase__InfluenzaA__AIT38375
MNPNQKIITIGSVCMTIGMVNLILQIGNIISIWISHSIQLGNQNQIEICNQSVITYENNTWVNQTYVNISNTNFAAGQSVVPVKLAGNSSLCSVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25814 - protein, 469 aa, Artificial Sequence
  neuraminidase__InfluenzaA__AIT93148
MNPNQKIITIGSVCMTIGMANLILQIGNIISIWVSHSIQLGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNKFSIKQDIVGINEWSGYSGSFVQHPELTGLDCIRPCFWVELIRGRPEENTIWTSGSSISFCGVNSDTVGWSWPDGAELPFTIDK

SEQ ID NO: 25815 - protein, 469 aa, Artificial Sequence; identical to SEQ ID NO: 18640
  neuraminidase__InfluenzaA__AIU39701

SEQ ID NO: 25816 - protein, 469 aa, Artificial Sequence; identical to SEQ ID NO: 16738
  neuraminidase__InfluenzaA__AIU39703

SEQ ID NO: 25817 - protein, 469 aa, Artificial Sequence
  neuraminidase__InfluenzaA__AIU39705
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDNTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25818 - protein, 470 aa, Artificial Sequence
  neuraminidase__InfluenzaA__AIU46611
MNPNQKITCISATGMTLSVVSMLIGIANLGLNIGLHYKVGDSTNINIPNMNETSPTTTIINNHPQNNFTNITNIIVTRNEEGHLLNLTKPLCEVNSWHILSKDNAIRIGEDAHIIVTREPYLSCDPQGCRMFALSQGTTLRGKHANGTIHDRSPFRALVSWEMGQAPSPYNTRVECIGWSSTSCHDGISRMSICISGPNNNASAVVWYGGRPVTEIPSWAGNILRTQESECVCHGGICPVVMTDGPANNRAETKIIYFKEGKIKKIEELKGDAQHIEECSCYGASEMIKCICRDNWKGANRPVITIDPEMMTHTSKYLCSKILTDTSRPNDPTNGNCEAPITGGSPDPGVKGFAFLDGENSWLGRTISKDSRSGYEMLKVPNAETDTQSGAISHQIIVNNQNWSGYSGAFIDYWANKECFNPCFYVELIRGRPKESSVLWTSNSIVALCGSKERLGSWSWHDGAEIIYFK

SEQ ID NO: 25819 - protein, 469 aa, Artificial Sequence
  neuraminidase__InfluenzaA__AIV09221
MNPNQKIITIGSVCMTIGMANLILQIGNITSIWISHSIQIGNRNQIEACNQSVITYENNTWVNQTYVNISNTNFAVGQSVVPVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECVCVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVPSNGANGVKGFSFKYGNGVWIGRTKSISSRNGFEMIWDPNGWTETDNDFSIKQDIVGINEWSGYSGSFVQHPELTGLDCIRPCFWVELIRGRPKENTIWTSGSSISFCGVNSNTVDWSWPDGAELPFTIDK

SEQ ID NO: 25820 - protein, 469 aa, Artificial Sequence
  neuraminidase__InfluenzaA__AIW60703
MNPNQKIITIGSVSLTIATICFLMQIVILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPQYSGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIGGWSKPNSKLQINRQVIVDRGNRSGYSGIFSVEGKNCINRCFYVELIRGRKQETEVWWTSNSIVVFCGTSGTYGTGSWPDGADINLMPI

SEQ ID NO: 25821 - protein, 469 aa, Artificial Sequence
  neuraminidase__InfluenzaA__AIW60704
MNPNQKIITIGSVSLTIATICFLMQIVILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDIVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPQYSGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIGGWSKPNSKLQINRQVIVDRGNRSGYSGIFSVEGKNCINRCFYVELIRGRKQETEVWWTSNSIVVFCGTSGTYGTGSWPDGADINLMPI

SEQ ID NO: 25822 - protein, 469 aa, Artificial Sequence
  neuraminidase__InfluenzaA__AIW60705
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYSGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 25823 - protein, 469 aa, Artificial Sequence; identical to SEQ ID NO: 25822
  neuraminidase__InfluenzaA__AIW60706

SEQ ID NO: 25824 - protein, 469 aa, Artificial Sequence
  neuraminidase__InfluenzaA__AIW60708
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYNGRLVDSIGSWSKKILRTQESECVCINGTCTVVMTDGSASGKADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIEGWSNPNSKLQINRQVIVDRGNSSGYSGIFSVEGKSCINRCFYVELIRGRKQETEVWWTSNSIVVLCGTSGTYGTGSWPDGADINLMPI

SEQ ID NO: 25825 - protein, 469 aa, Artificial Sequence
  neuraminidase__InfluenzaA__AIW60710
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPTVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVESKSCINRCFYVELIRGRKQETEVLWTSNSIVVFCGTSGTYGTGSWPDGADINLMPI

SEQ ID NO: 25826 - protein, 469 aa, Artificial Sequence; identical to SEQ ID NO: 14591
  neuraminidase__InfluenzaA__AIW60711

SEQ ID NO: 25827 - protein, 469 aa, Artificial Sequence; identical to SEQ ID NO: 14591
  neuraminidase__InfluenzaA__AIW60712

SEQ ID NO: 25828 - protein, 469 aa, Artificial Sequence
  neuraminidase__InfluenzaA__AIW60713
MNPNQKIITIGSVSLTISTICFFMQIAILITTVTLHFKQYEFSSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIASSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 25829 - protein, 469 aa, Artificial Sequence
  neuraminidase__InfluenzaA__AIW60714
MNPNQKIITIGSVSLTISTICFFMQIAILITTVTLHFKQYEFSSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIASSYVCSGLVGDTPRKNDSSSSSHCLDPNNEEGGHGVKGWAFDDGNDVWMGRTISEKLRSGYETFKVIEGWSNPNSKLQINRQVIVGRGNRSGYSGIFSVEGKSCINRCFYVELIRGRKEETEVLWTSNSIVVFCGTSGTYGTGSWPDGADINLMPI

SEQ ID NO: 25830 - protein, 469 aa, Artificial Sequence
  neuraminidase__InfluenzaA__AIW60715
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 25831 - protein, 469 aa, Artificial Sequence; identical to SEQ ID NO: 16511
  neuraminidase__InfluenzaA__AIW60716

SEQ ID NO: 25832 - protein, 469 aa, Artificial Sequence
  neuraminidase__InfluenzaA__AIY54970
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKTDSSSSSHCLDPNNEEGGHGVKGWAFDDGNDLWMGRTISQNLRSGYETFKVIEGWSNPNSKLQINRQVIVDRGNRSGYSGIFSVEGKSCINRCFYVELIRGRKQETEVLWTSNSIVVFCGTSGTYGTGSWPDGADINLMPI

SEQ ID NO: 25833 - protein, 469 aa, Artificial Sequence
  neuraminidase__InfluenzaA__AIY54974
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMSELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVKVDRGNRSGYSGIFSVEGKSCINRCFYVELIRGRKEETKVLWTSNSIVVFCGTSGTYGTGSWPDGADINLMPI

SEQ ID NO: 25834 - protein, 469 aa, Artificial Sequence
  neuraminidase__InfluenzaA__AIY54982
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKFRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 25835 - protein, 469 aa, Artificial Sequence
  neuraminidase__InfluenzaA__AIY54990
MNPNQKIITIGSVSLTISTICFFMQIAILITTVTLHFKQYEFSSPPNNQVMLCEPTIIERNITEIVYLTNTTIEKEICPKLAEYRNWSKPQCGITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 25836 - protein, 466 aa, Artificial Sequence
  neuraminidase__InfluenzaA__AJD78177
MNPNQKIIAIGSVSLIIAVICLLMQIAILTTTMTLHFMQNECSNPSNNQVMPCEPIIIERNTVHLNNTTIEREICPKAAEYKNWSKPQCQITGFAPFSKDNSIRLSAGGDIWVTREPYVSCSLDKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRVLFIREGKIINISPLSGSAQHVEECSCYPRYPEVRCVCRDNWKGSNRPILYINMADYSIESSYVCSGLVGDTPRNDDSSSSSNCRDPNNERGAPGVKGWAFDDGNDVWMGRTIKNGSRSGYETFRVVNGWTMANSKSQINRQVIVDSDDWSGYSGIFSVEGKKCINRCFYVELIRGRPQEPRVWWTSNSIIVFCGTSGTYGTGSWPDGANINFMPI

SEQ ID NO: 25837 - protein, 466 aa, Artificial Sequence
  neuraminidase__InfluenzaA__AJD78189
MNPNQKIIAIGSVSLIIAIICLLMQIAILTTTMTLHFRQNECNNSSNNQVMPCEPIIIERNTVHLNSTTIEREICPKVAEYKNWSKPQCQITGFAPFSKDNSIRLSAGGDIWVTREPYVSCSLDKCYQFALGQGTTLKNKHSNGTTHDRTSHRTLLMNELGVPFHLGTKQVCIAWSSSSCYDGKAWLHICVTGDDKNATASIIYNGMLVDSIGSWSKNILRTQESECVCINGTCAVVMTDGSASGKADTRVLFIREGKIINISPLSGSAQHVEECSCYPRYPEVRCVCRDNWKGSNRPILYINMADYSIESSYVCSGLVGDTPRNDDSSSSSNCKDPNSERGAPGVKGWAFDDGNDVWMGRTIKNGSRSGYETFRVLNGWTVANSKSQINRQVIVDSDDWSGYSGIFSVEGKKCINRCFYVELIRGRPQEPRVWWTSNSIIVFCGTSGTYGTGSWPDGANINFMPI

SEQ ID NO: 25838 - protein, 466 aa, Artificial Sequence
  neuraminidase__InfluenzaA__AJD78201
MNPNQKITAIGSVSLIIAIICLLMQIAILTTTMTLHFRQKECSNPSNNQVMPCEPIIIERNTVHLNSTTIEREICPKVAEYKNWSKPQCLITGFAPFSKDNSIRLSAGGDIWVTREPYVSCSPDKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGVADTRVLFIREGKIINIRPLSGSAQHVEECSCYPRYPEVRCVCRDNWKGSNRPIIYINMADYSIESSYVCSGLVGDTPRNDDSSSSSNCRDPNNERGAPGVKGWAFDDGNDVWMGRTIKNGSRSGYETFRVINGWTMANSKSQINRQVIVDSDDWSGYSGIFSVEGKKCINRCFYVELIRGRPQEPRVWWTSNSIIVFCGTSGTYGTGSWPDGANINFMPI

SEQ ID NO: 25839 - protein, 466 aa, Artificial Sequence
  neuraminidase__InfluenzaA__AJD78213
MNPNQKITAIGSVSLIIAIICLFMQIAILTTTMTLHFRQKECSNPSNNQVMPCEPIIIERNTVHLNSTTIEREICPKVAEYKNWSKPQCLITGFAPFSKDNSIRLSAGGDIWVTREPYVSCSPDKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGVADTRVLFIREGKIINIRPLSGSAQHVEECSCYPRYPEVRCVCRDNWKGSNRPIIYINMADYSIESSYVCSGLVGDTPRNDDSSSSSNCRDPNNERGAPGVKGWAFDDGNDVWMGRTIKNGSRSGYETFRVINGWTMANSKSQINRQVIVDSDDWSGYSGIFSVEGKKCINRCFYVELIRGRPQEPRVWWTSNSIIVFCGTSGTYGTGSWPDGANINFMPI

SEQ ID NO: 25840 - protein, 469 aa, Artificial Sequence; identical to SEQ ID NO: 22922
  neuraminidase__InfluenzaA__AJI80140

SEQ ID NO: 25841 - protein, 469 aa, Artificial Sequence; identical to SEQ ID NO: 22922
  neuraminidase__InfluenzaA__AJI80152

SEQ ID NO: 25842 - protein, 469 aa, Artificial Sequence; identical to SEQ ID NO: 25698
  neuraminidase__InfluenzaA__AJI80164

SEQ ID NO: 25843 - protein, 469 aa, Artificial Sequence; identical to SEQ ID NO: 25637
  neuraminidase__InfluenzaA__AJI80175

SEQ ID NO: 25844 - protein, 469 aa, Artificial Sequence; identical to SEQ ID NO: 25637
  neuraminidase__InfluenzaA__AJI80187

SEQ ID NO: 25845 - protein, 469 aa, Artificial Sequence; identical to SEQ ID NO: 25637
  neuraminidase__InfluenzaA__AJI80199

SEQ ID NO: 25846 - protein, 469 aa, Artificial Sequence; identical to SEQ ID NO: 25637
  neuraminidase__InfluenzaA__AJI80211

SEQ ID NO: 25847 - protein, 469 aa, Artificial Sequence; identical to SEQ ID NO: 23871
  neuraminidase__InfluenzaA__AJI80223

SEQ ID NO: 25848 - protein, 469 aa, Artificial Sequence; identical to SEQ ID NO: 25637
  neuraminidase__InfluenzaA__AJI80235

SEQ ID NO: 25849 - protein, 469 aa, Artificial Sequence; identical to SEQ ID NO: 23871
  neuraminidase__InfluenzaA__AJI80247

SEQ ID NO: 25850 - protein, 469 aa, Artificial Sequence; identical to SEQ ID NO: 25656
  neuraminidase__InfluenzaA__AJI80259

SEQ ID NO: 25851 - protein, 469 aa, Artificial Sequence; identical to SEQ ID NO: 22146
  neuraminidase__InfluenzaA__AJI80271

SEQ ID NO: 25852 - protein, 469 aa, Artificial Sequence; identical to SEQ ID NO: 25637
  neuraminidase__InfluenzaA__AJI80283

SEQ ID NO: 25853 - protein, 469 aa, Artificial Sequence
  neuraminidase__InfluenzaA__AJI80306
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVLDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINKQVIVDRGDRSGYSGIFSVEGKSCINRCFYVELIRGRKEETEVLWTSNSIVVFCGTSGTYGTGSWPDGADLNLMPI

SEQ ID NO: 25854 - protein, 469 aa, Artificial Sequence
  neuraminidase__InfluenzaA__AJI80318
MNPNQKIITIGSVCMTIGMANLILQIGNIISIWISHSIQLGNQSQIEACNQNVITYENNTWVNQTYVNISNTNFATGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWKNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25855 - protein, 469 aa, Artificial Sequence
  neuraminidase__InfluenzaA__AJI80329
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWKNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25856 - protein, 469 aa, Artificial Sequence
  neuraminidase__InfluenzaA__AJI80340
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWKNNILRTQESECACVNGSCFTIMTDGPSDGQASYKIFRIEKGKIVKSVEMNAPNYYYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25857 - protein, 469 aa, Artificial Sequence; identical to SEQ ID NO: 22146
  neuraminidase__InfluenzaA__AJI80351

SEQ ID NO: 25858 - protein, 469 aa, Artificial Sequence
  neuraminidase__InfluenzaA__AJI80363
MNPNQKIITIGSVSLTISTICFFMQIAILITTVTLHFKQYEFNSLPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTARDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGGAQHVEECSCYPRYPGVRCVCRDNWKGSNRPIVDINIKDHSIVSSYVCSGLVGDTPRKNDSSSSSHCLNPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25859 - protein, 469 aa, Artificial Sequence
  neuraminidase__InfluenzaA__AJI80375
MNPNQKIITIGSVSLTISTICLFMQIAILITTVTLHFKQHEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25860 - protein, 469 aa, Artificial Sequence; identical to SEQ ID NO: 25676
  neuraminidase__InfluenzaA__AJI80387

SEQ ID NO: 25861 - protein, 469 aa, Artificial Sequence; identical to SEQ ID NO: 25676
  neuraminidase__InfluenzaA__AJI80398

SEQ ID NO: 25862 - protein, 469 aa, Artificial Sequence; identical to SEQ ID NO: 25676
  neuraminidase__InfluenzaA__AJI80409

SEQ ID NO: 25863 - protein, 469 aa, Artificial Sequence; identical to SEQ ID NO: 25676
  neuraminidase__InfluenzaA__AJI80420

SEQ ID NO: 25864 - protein, 469 aa, Artificial Sequence; identical to SEQ ID NO: 25676
  neuraminidase__InfluenzaA__AJI80431

SEQ ID NO: 25865 - protein, 469 aa, Artificial Sequence; identical to SEQ ID NO: 25671
  neuraminidase__InfluenzaA__AJI80442

SEQ ID NO: 25866 - protein, 469 aa, Artificial Sequence; identical to SEQ ID NO: 25676
  neuraminidase__InfluenzaA__AJI80454

SEQ ID NO: 25867 - protein, 469 aa, Artificial Sequence; identical to SEQ ID NO: 25671
  neuraminidase__InfluenzaA__AJI80465

SEQ ID NO: 25868 - protein, 469 aa, Artificial Sequence; identical to SEQ ID NO: 25676
  neuraminidase__InfluenzaA__AJI80477

SEQ ID NO: 25869 - protein, 469 aa, Artificial Sequence; identical to SEQ ID NO: 25676
  neuraminidase__InfluenzaA__AJI80488

SEQ ID NO: 25870 - protein, 469 aa, Artificial Sequence; identical to SEQ ID NO: 25698
  neuraminidase__InfluenzaA__AJI80499

SEQ ID NO: 25871 - protein, 469 aa, Artificial Sequence; identical to SEQ ID NO: 25676
  neuraminidase__InfluenzaA__AJI80510

SEQ ID NO: 25872 - protein, 469 aa, Artificial Sequence; identical to SEQ ID NO: 25698
  neuraminidase__InfluenzaA__AJI80521

SEQ ID NO: 25873 - protein, 469 aa, Artificial Sequence
  neuraminidase__InfluenzaA__AJJ98767
MNPNQKIITIGSVSLTISTICFFMQIAILITTVTLHFKQYEFNSPSNNQVMLCEPTIIERNITEIVYLTNTTIEKEKCPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGDDVWMGRTISEKSRLGYETFKVIEGWSNPKSKLQINRQVIVDRGNRSGYSGIFSVEGKSCINRCFYVELIRGRKEETDVLWTSNSIVVFCGTSGTYGTGSWPDGADINLMPI

SEQ ID NO: 25874 - protein, 469 aa, Artificial Sequence
  neuraminidase__InfluenzaA__AJJ98779
MNPNQKIITIGSVSLTISTICFFMQTAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWTKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 25875 - protein, 469 aa, Artificial Sequence; identical to SEQ ID NO: 22146
  neuraminidase__InfluenzaA__AJJ98791

SEQ ID NO: 25876 - protein, 469 aa, Artificial Sequence
  neuraminidase__InfluenzaA__AJJ98803
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNKVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25877 - protein, 469 aa, Artificial Sequence; identical to SEQ ID NO: 22146
  neuraminidase__InfluenzaA__AJJ98815

SEQ ID NO: 25878 - protein, 469 aa, Artificial Sequence
  neuraminidase__InfluenzaA__AJJ98827
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHNIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25879 - protein, 469 aa, Artificial Sequence; identical to SEQ ID NO: 21143
  neuraminidase__InfluenzaA__AJJ98839

SEQ ID NO: 25880 - protein, 469 aa, Artificial Sequence; identical to SEQ ID NO: 19518
  neuraminidase__InfluenzaA__AJJ98851

SEQ ID NO: 25881 - protein, 469 aa, Artificial Sequence
  neuraminidase__InfluenzaA__AJJ98863
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRERTPYRTLLMNELGVPFHLGTKQVCIAWSSSSCHDGKAWLHVCITGDDKNATASFIYNGRLVDSVVSWSKEILRTQESECICINGTCTVVMTDGSASGKADTKILFIEEGKIVHTSTLSGSAQHVEECSCYPRYPGVRCVCRDNWKGSNRPIVDINMKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 25882 - protein, 469 aa, Artificial Sequence
  neuraminidase__InfluenzaA__AJJ98875
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNDTVRNRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 25883 - protein, 469 aa, Artificial Sequence
  neuraminidase__InfluenzaA__AJJ98887
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRNRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETDVLWTSNSIVVFCGTSGTYGTGSWPDGADINLMPI

SEQ ID NO: 25884 - protein, 469 aa, Artificial Sequence
  neuraminidase__InfluenzaA__AJJ98899
MNPNQKIITIGSVSLTISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRNRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 25885 - protein, 469 aa, Artificial Sequence; identical to SEQ ID NO: 22146
  neuraminidase__InfluenzaA__AJJ98911

SEQ ID NO: 25886 - protein, 469 aa, Artificial Sequence; identical to SEQ ID NO: 22922
  neuraminidase__InfluenzaA__AJJ98923

SEQ ID NO: 25887 - protein, 469 aa, Artificial Sequence
  neuraminidase__InfluenzaA__AJJ98935
MNPNQKIITIGSVSLTISTICFFMQIAILITTVTLHFKRYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25888 - protein, 469 aa, Artificial Sequence
  neuraminidase__InfluenzaA__AJJ98947
MNPNQKIITIGSVSLTISTICFFMQIAILITTVTLHFKQYEFNSPPNNQVTLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGNDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 25889 - protein, 469 aa, Artificial Sequence
  neuraminidase__InfluenzaA__AJJ98971
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRNRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 25890 - protein, 469 aa, Artificial Sequence
  neuraminidase__InfluenzaA__AJJ98995
MNPNQKIITIGSVSLTISTICFFMQIAILITTVTLHFKQYEFNSPPNNQVMLCEPTIIERNMTEIVYLTNTTIEKEICPKPAEYRNWSKPQCDITGFAPFSKDNSIRLSAGGDIWVTREPYVSCDPDKCYQFALGQGTTLNNVHSNNIVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRSDRSGYSGIFSVEGKSCINRCFYVELIRGRKEETEVLWTSNSIVVFCGTSGTYGTGSWPDGADLNLMPI

SEQ ID NO: 25891 - protein, 469 aa, Artificial Sequence; identical to SEQ ID NO: 21143
  neuraminidase__InfluenzaA__AJJ99007

SEQ ID NO: 25892 - protein, 469 aa, Artificial Sequence
  neuraminidase__InfluenzaA__AJJ99019
MNPNQKIITIGSVSLTISTICFFMQTAILITTVTLHFKQCEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSNYVCSGLVGDTPRKNDSSSSSHCLDPNNEEGGHGVKGWAFDDGNDVWMGRTISEKSRFGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 25893 - protein, 469 aa, Artificial Sequence
  neuraminidase__InfluenzaA__AJJ99031
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTINNVHSNDTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 25894 - protein, 469 aa, Artificial Sequence
  neuraminidase__InfluenzaA__AJJ99043
MNPNQKIITIGSVSLTISTICFFMQIAILITTVTLHFKQYEFNSPPNNQVMLCEPTIIERNITEIVYLTNTTIEKEICPKLAEYRKWSKPQCNITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWRGSNRPIVDINMKDYSIVSSYVCSGLVGDTPRKNDSSSSGHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 25895 - protein, 469 aa, Artificial Sequence
  neuraminidase__InfluenzaA__AJJ99067
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRGRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25896 - protein, 469 aa, Artificial Sequence
  neuraminidase__InfluenzaA__AJJ99079
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRNRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25897 - protein, 469 aa, Artificial Sequence
  neuraminidase__InfluenzaA__AJJ99091
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDLWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 25898 - protein, 469 aa, Artificial Sequence
  neuraminidase__InfluenzaA__AJJ99103
MNPNQKIITIGSVSLTISTICFFMQIAILITTVTLHFKQYEFNSPPNNQVMLCEPTIIERNMTEIVYLTNTTIEKEICPKPAEYRNWSKPQCDITGFAPFSKDNSIRLSAGGDIWVTREPYVSCDPDKCYQFALGQGTTLNNVHSNNTVRNRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRSDRSGYSGIFSVEGKSCINRCFYVELIRGRKEETEVLWTSNSIVVFCGTSGTYGTGSWPDGADLNLMPI

SEQ ID NO: 25899 - protein, 469 aa, Artificial Sequence; identical to SEQ ID NO: 25365
  neuraminidase__InfluenzaA__AJJ99115

SEQ ID NO: 25900 - protein, 469 aa, Artificial Sequence; identical to SEQ ID NO: 24285
  neuraminidase__InfluenzaA__AJJ99127

SEQ ID NO: 25901 - protein, 469 aa, Artificial Sequence; identical to SEQ ID NO: 25573
  neuraminidase__InfluenzaA__AJJ99139

SEQ ID NO: 25902 - protein, 469 aa, Artificial Sequence
  neuraminidase__InfluenzaA__AJJ99151
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 25903 - protein, 469 aa, Artificial Sequence; identical to SEQ ID NO: 16599
  neuraminidase__InfluenzaA__AJJ99163

SEQ ID NO: 25904 - protein, 469 aa, Artificial Sequence
  neuraminidase__InfluenzaA__AJJ99175
MNPNQKIITIGSVSLTISTICLFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGTDINLMPI

SEQ ID NO: 25905 - protein, 469 aa, Artificial Sequence
  neuraminidase__InfluenzaA__AJJ99199
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRNRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 25906 - protein, 469 aa, Artificial Sequence; identical to SEQ ID NO: 16743
  neuraminidase__InfluenzaA__AJJ99211

SEQ ID NO: 25907 - protein, 469 aa, Artificial Sequence
  neuraminidase__InfluenzaA__AJJ99223
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRNRTPYRTLLMNELGVPFHLGTKQVCIAWSSSSCHDGKAWLHVCITGDDKNATASFIYNGRLVDSIVSWSKEILRTQESECVCINGTCTVVMTDGSASGEADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWVGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 25908 - protein, 469 aa, Artificial Sequence
  neuraminidase__InfluenzaA__AJJ99235
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGEADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 25909 - protein, 469 aa, Artificial Sequence
  neuraminidase__InfluenzaA__AJJ99246
MNPNQKIITIGSVCMTIGMANLILQIGNIISIWISHSIQLGNQSQIETCNQNVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACLNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSSGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25910 - protein, 469 aa, Artificial Sequence
  neuraminidase__InfluenzaA__AJJ99257
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVPSNGANGVKGFSFKYGNGVWIGRTKSISSRKGFEMIWDPNGWTGTDNSFSIKQDIVGTNEWSGYSGSFVQHPELTGLDCIRPCFWVELIRGRPKENTIWTSGSSISFCGVNSGTVGWSWPDGAELPFTIDK

SEQ ID NO: 25911 - protein, 470 aa, Artificial Sequence; identical to SEQ ID NO: 16632
  neuraminidase__InfluenzaA__AJJ99269

SEQ ID NO: 25912 - protein, 469 aa, Artificial Sequence; identical to SEQ ID NO: 20958
  neuraminidase__InfluenzaA__AJJ99280

SEQ ID NO: 25913 - protein, 469 aa, Artificial Sequence; identical to SEQ ID NO: 20709
  neuraminidase__InfluenzaA__AJJ99291

SEQ ID NO: 25914 - protein, 470 aa, Artificial Sequence
  neuraminidase__InfluenzaA__AJJ99303
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSMELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 25915 - protein, 469 aa, Artificial Sequence
  neuraminidase__InfluenzaA__AJJ99314
MNPNQKIITIGSACMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25916 - protein, 470 aa, Artificial Sequence
  neuraminidase__InfluenzaA__AJJ99326
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGLGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 25917 - protein, 469 aa, Artificial Sequence; identical to SEQ ID NO: 18382
  neuraminidase__InfluenzaA__AJJ99337

SEQ ID NO: 25918 - protein, 469 aa, Artificial Sequence; identical to SEQ ID NO: 17845
  neuraminidase__InfluenzaA__AJJ99348

SEQ ID NO: 25919 - protein, 469 aa, Artificial Sequence; identical to SEQ ID NO: 16738
  neuraminidase__InfluenzaA__AJJ99359

SEQ ID NO: 25920 - protein, 469 aa, Artificial Sequence
  neuraminidase__InfluenzaA__AJJ99370
MNPNQKIITIGSVCMIIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPHRTLMSCPIGEVPSPYNSRFESVAWSASACHDGINWLTIGISGPDNGAVAVLKYNGIITDTIKSWRNNILRTQESECACVNGSCFTIMTDGPSDRQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25921 - protein, 469 aa, Artificial Sequence; identical to SEQ ID NO: 20257
  neuraminidase__InfluenzaA__AJJ99381

SEQ ID NO: 25922 - protein, 469 aa, Artificial Sequence
  neuraminidase__InfluenzaA__AJJ99392
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSPNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAKLPFTIDK

SEQ ID NO: 25923 - protein, 469 aa, Artificial Sequence; identical to SEQ ID NO: 16738
  neuraminidase__InfluenzaA__AJJ99403

SEQ ID NO: 25924 - protein, 470 aa, Artificial Sequence; identical to SEQ ID NO: 17461
  neuraminidase__InfluenzaA__AJJ99415

SEQ ID NO: 25925 - protein, 470 aa, Artificial Sequence
  neuraminidase__InfluenzaA__AJJ99427
MNPNQKIITIGSISIAIGIISLMLQIGNIISIWASHSIQTGSQNNTGICNQRIITYENSTWVNHTYVNINNTNVVAGEDKTSVTLAGNSSLCSISGWAVYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSDKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWINTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 25926 - protein, 470 aa, Artificial Sequence
  neuraminidase__InfluenzaA__AJJ99439
MNPNQKIITIGSISIAIGIISLMLQIGNIISIWASHSIQTGSQNNTGICNQRIITYENSTWVNHTYVNINNTNVVAGEDKTSVTLAGNSSLCSTSGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 25927 - protein, 470 aa, Artificial Sequence
  neuraminidase__InfluenzaA__AJJ99451
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNRTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 25928 - protein, 470 aa, Artificial Sequence; identical to SEQ ID NO: 16632
  neuraminidase__InfluenzaA__AJJ99463

SEQ ID NO: 25929 - protein, 469 aa, Artificial Sequence
  neuraminidase__InfluenzaA__AJJ99474
MNPNQKIITIGSVCMTIGIANLILQIGNIISIWISHSIQLGNQNQIETCNQSVIIYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIIKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNSFSIKQDIVGINEWSGYSGSFVQHPELTGLDCIRPCFWVELIRGRPKENTIWTSGSSISFCGVNSGTVGWSWPDGAELPFTIDK

SEQ ID NO: 25930 - protein, 469 aa, Artificial Sequence; identical to SEQ ID NO: 20709
  neuraminidase__InfluenzaA__AJJ99496

SEQ ID NO: 25931 - protein, 469 aa, Artificial Sequence
  neuraminidase__InfluenzaA__AJJ99507
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGANRPWVSFNQNLEYQIGYICSGIFGDNPRPNDKTGSCGPVSSNGANGVKGFSFKYDNGVWIGRTKSISSRNGFEMIWDPNGWTGTDNDFSIKQDIVGINEWSGYSGSFVQHPELTGLDCIRPCFWVELIRGRPKENTIWTSGSSISFCGVNSDTVGWSWPDGAELPFTIDK

SEQ ID NO: 25932 - protein, 469 aa, Artificial Sequence; identical to SEQ ID NO: 16738
  neuraminidase__InfluenzaA__AJJ99518

SEQ ID NO: 25933 - protein, 469 aa, Artificial Sequence
  neuraminidase__InfluenzaA__AJJ99529
MNPNQKIITIGSVCMTIGMANLILQVGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGFNWLTIGISGPDNGAVAVLKYNGIITDTIKSWRNNILRTQESECACVNGSCFTIMTDGPSDGQASYKIFRIEKGKIIKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNSFSIKQDIVGINEWSGYSGSFVQHPELTGLDCIRPCFWVELIRGRPKENTIWTSGSSISFCGVNSGTVGWSWPDGAELPFTIDK

SEQ ID NO: 25934 - protein, 469 aa, Artificial Sequence
  neuraminidase__InfluenzaA__AJJ99540
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSKITCVCRDNWHGSNRPWVSFNQNLEYQIGYICSGIFGDNPRPNDKTGSCGPVSSNGANGVKGFSFKYGNGIWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25935 - protein, 469 aa, Artificial Sequence
  neuraminidase__InfluenzaA__AJJ99551
MNPNQKIITIGSVCMTIGMANLILQIGNIISIWISHSIQLGNQSQTETCNQSVITYENNTWVNQTYVNISNTNPAAGQSVVSVKLAGNSSLCPVSGWAIYSKDNSIRIGSKGDVFVIREPFISCSSLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25936 - protein, 469 aa, Artificial Sequence; identical to SEQ ID NO: 20725
  neuraminidase__InfluenzaA__AJJ99562

SEQ ID NO: 25937 - protein, 469 aa, Artificial Sequence
  neuraminidase__InfluenzaA__AJJ99573
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDVVGINEWSGYSGSFVQHPELTGLDCIRPCFWVELIRGRPKENTIWTSGSSISFCGVNSDTVGWSWPDGAELPFTIDK

SEQ ID NO: 25938 - protein, 469 aa, Artificial Sequence; identical to SEQ ID NO: 25915
  neuraminidase__InfluenzaA__AJJ99584

SEQ ID NO: 25939 - protein, 469 aa, Artificial Sequence
  neuraminidase__InfluenzaA__AJJ99595
MNPNQKIITIGSVCMTIGMANLIFQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25940 - protein, 469 aa, Artificial Sequence
  neuraminidase__InfluenzaA__AJJ99606
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGVITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25941 - protein, 470 aa, Artificial Sequence; identical to SEQ ID NO: 17461
  neuraminidase__InfluenzaA__AJJ99618

SEQ ID NO: 25942 - protein, 470 aa, Artificial Sequence
  neuraminidase__InfluenzaA__AJJ99630
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSMKQNVVAITDWSGYSGSFVQHPELTGLDCIRPCFWVELVRGLPRENTTIWTSGSSISFCGVNSDTANWSWPDGAELPFTIDK

SEQ ID NO: 25943 - protein, 470 aa, Artificial Sequence; identical to SEQ ID NO: 17461
  neuraminidase__InfluenzaA__AJJ99642

SEQ ID NO: 25944 - protein, 470 aa, Artificial Sequence; identical to SEQ ID NO: 17461
  neuraminidase__InfluenzaA__AJJ99654

SEQ ID NO: 25945 - protein, 470 aa, Artificial Sequence
  neuraminidase__InfluenzaA__AJJ99666
MNPNQKIITIGSISIAIGIISLMLQIGNIISIWASHSIQTGSQNNTGICNQRIITYENSTWVNHTYVNINNNNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 25946 - protein, 469 aa, Artificial Sequence
  neuraminidase__InfluenzaA__AJJ99677
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIIKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNSFSIKQDIVGMNEWSGYSGSFVQHPELTGLDCIRPCFWVELIRGRPKENTIWTSGSSISFCGVNSGTVGWSWPDGAELPFTIDK

SEQ ID NO: 25947 - protein, 469 aa, Artificial Sequence
  neuraminidase__InfluenzaA__AJJ99688
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIIKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNSFSIKQDIVGINEWSGYSGSFVQHPELTGLDCIRPCFWVELIRGRPKENTIWTSGSSISFCGVNSGTVGWSWPDGAELPFTIDK

SEQ ID NO: 25948 - protein, 469 aa, Artificial Sequence
  neuraminidase__InfluenzaA__AJJ99710
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSKITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25949 - protein, 469 aa, Artificial Sequence; identical to SEQ ID NO: 20257
  neuraminidase__InfluenzaA__AJJ99721

SEQ ID NO: 25950 - protein, 469 aa, Artificial Sequence; identical to SEQ ID NO: 20257
  neuraminidase__InfluenzaA__AJJ99732

SEQ ID NO: 25951 - protein, 469 aa, Artificial Sequence; identical to SEQ ID NO: 20957
  neuraminidase__InfluenzaA__AJJ99743

SEQ ID NO: 25952 - protein, 469 aa, Artificial Sequence; identical to SEQ ID NO: 18291
  neuraminidase__InfluenzaA__AJJ99754

SEQ ID NO: 25953 - protein, 469 aa, Artificial Sequence
  neuraminidase__InfluenzaA__AJJ99765
MNPNQKIITIGSVCMTIGMANLILQIGNIISIWISHSIQLGNQNQIETCNQSVITYENNTWVNQTYVNISNTNFATGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25954 - protein, 470 aa, Artificial Sequence
  neuraminidase__InfluenzaA__AJJ99777
MNPNQKIITIGSISIAIGIISLILQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTAVWTSGSSISFCGVNSDTANWSWPDGAELPFTIDK

SEQ ID NO: 25955 - protein, 469 aa, Artificial Sequence; identical to SEQ ID NO: 16738
  neuraminidase__InfluenzaA__AJJ99788

SEQ ID NO: 25956 - protein, 470 aa, Artificial Sequence
  neuraminidase__InfluenzaA__AJJ99800
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFIIDK

SEQ ID NO: 25957 - protein, 470 aa, Artificial Sequence; identical to SEQ ID NO: 17461
  neuraminidase__InfluenzaA__AJJ99812

SEQ ID NO: 25958 - protein, 470 aa, Artificial Sequence
  neuraminidase__InfluenzaA__AJJ99824
MNPNQKIITIGSISIAIGTISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 25959 - protein, 469 aa, Artificial Sequence; identical to SEQ ID NO: 25947
  neuraminidase__InfluenzaA__AJJ99835

SEQ ID NO: 25960 - protein, 469 aa, Artificial Sequence; identical to SEQ ID NO: 20257
  neuraminidase__InfluenzaA__AJJ99846

SEQ ID NO: 25961 - protein, 469 aa, Artificial Sequence; identical to SEQ ID NO: 20257
  neuraminidase__InfluenzaA__AJJ99857

SEQ ID NO: 25962 - protein, 469 aa, Artificial Sequence
  neuraminidase__InfluenzaA__AJJ99868
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSVITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQNIVGINEWSGYSGSFVQHPELTGLDCIRPCFWVELIRGRPKENTIWTSGSSISFCGVNSDTVGWSWPDGAELPFTIDK

SEQ ID NO: 25963 - protein, 469 aa, Artificial Sequence; identical to SEQ ID NO: 19157
  neuraminidase__InfluenzaA__AJJ99879

SEQ ID NO: 25964 - protein, 469 aa, Artificial Sequence; identical to SEQ ID NO: 16738
  neuraminidase__InfluenzaA__AJJ99890

SEQ ID NO: 25965 - protein, 469 aa, Artificial Sequence
  neuraminidase__InfluenzaA__AJJ99901
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNSFSIKQDIVGINEWSGYSGSFVQHPELTGLDCIRPCFWVELIRGRPKENTIWTSGSSISFCGVDSGTVGWSWPDGAELPFTIDK

SEQ ID NO: 25966 - protein, 469 aa, Artificial Sequence
  neuraminidase__InfluenzaA__AJJ99912
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSKITCVCRDNWHGSNRPWVSFNQNLEYQIGYICSGIFGDNPRPKDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25967 - protein, 469 aa, Artificial Sequence; identical to SEQ ID NO: 20257
  neuraminidase__InfluenzaA__AJJ99923

SEQ ID NO: 25968 - protein, 469 aa, Artificial Sequence; identical to SEQ ID NO: 20709
  neuraminidase__InfluenzaA__AJJ99934

SEQ ID NO: 25969 - protein, 469 aa, Artificial Sequence; identical to SEQ ID NO: 20257
  neuraminidase__InfluenzaA__AJJ99945

SEQ ID NO: 25970 - protein, 469 aa, Artificial Sequence
  neuraminidase__InfluenzaA__AJJ99956
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVLSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25971 - protein, 469 aa, Artificial Sequence; identical to SEQ ID NO: 16738
  neuraminidase__InfluenzaA__AJJ99967

SEQ ID NO: 25972 - protein, 470 aa, Artificial Sequence
  neuraminidase__InfluenzaA__AJJ99991
MNPNQKIITIGSISIAIGIISLMLQIGNIISIWASHSIQTGSQNNTGICNQRIITYENCTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 25973 - protein, 469 aa, Artificial Sequence; identical to SEQ ID NO: 25947
  neuraminidase__InfluenzaA__AJK00003

SEQ ID NO: 25974 - protein, 469 aa, Artificial Sequence
  neuraminidase__InfluenzaA__AJK00014
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGVITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSTKQDIVGINEWSGYSGSFVQHPELTGLDCIRPCFWVELIRGRPKENTIWTSGSIISFCGVNSDTVGWSWPDGAELPFTIDN

SEQ ID NO: 25975 - protein, 469 aa, Artificial Sequence
  neuraminidase__InfluenzaA__AJK00025
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNSFSIKQDIVGINEWSGYSGSFVQHPELTGLDCIRPCFWVELIRGRPKENTIWTSGSSISFCGVNSGTVGWSWPDGAELPFTIDK

SEQ ID NO: 25976 - protein, 469 aa, Artificial Sequence
  neuraminidase__InfluenzaA__AJK00036
MNPNQKIITIGSVCMTIGMANLILQIGNIISIWISHSIQLGNQSQIETCNQSVITYENNTWVNQTYVNISNINFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25977 - protein, 469 aa, Artificial Sequence; identical to SEQ ID NO: 20957
  neuraminidase__InfluenzaA__AJK00047

SEQ ID NO: 25978 - protein, 469 aa, Artificial Sequence; identical to SEQ ID NO: 20957
  neuraminidase__InfluenzaA__AJK00058

SEQ ID NO: 25979 - protein, 469 aa, Artificial Sequence
  neuraminidase__InfluenzaA__AJK00069
MNPNQKIITIGSVCMTIGMANLILQIGNIISIWISHSIQLGNQNQIETCNQSVITYENNTWVNQTYFNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25980 - protein, 470 aa, Artificial Sequence; identical to SEQ ID NO: 17461
  neuraminidase__InfluenzaA__AJK00081

SEQ ID NO: 25981 - protein, 470 aa, Artificial Sequence; identical to SEQ ID NO: 16632
  neuraminidase__InfluenzaA__AJK00093

SEQ ID NO: 25982 - protein, 470 aa, Artificial Sequence
  neuraminidase__InfluenzaA__AJK00105
MSPNQKIITIGSISIAIGIISLMLQIGNTISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 25983 - protein, 469 aa, Artificial Sequence; identical to SEQ ID NO: 19013
  neuraminidase__InfluenzaA__AJK00116

SEQ ID NO: 25984 - protein, 469 aa, Artificial Sequence; identical to SEQ ID NO: 17845
  neuraminidase__InfluenzaA__AJK00127

SEQ ID NO: 25985 - protein, 469 aa, Artificial Sequence; identical to SEQ ID NO: 16738
  neuraminidase__InfluenzaA__AJK00138

SEQ ID NO: 25986 - protein, 449 aa, Artificial Sequence
  neuraminidase__InfluenzaA__AJK00152
MNPNQKIITIGSICMVTGIVSLMLQIGNIISMWVSHSIQTRNQHQTEPIRNTNFLTENAVASVTLAGNSSLCPIRGWAVHSKDNSIRIGSKGDVFVIREPFISCSHLECRTFFLTQGALINDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELNAPNYHYEECSCYPDAGEITCVCRDNWHGSNRPWVSFNQNLEYQIGYICSGVFGDNPRPNDGTGSCGPVSPNGAYGIKGFSFKYGNGVWIGRTKSTNSRSGFEMIWDPNGWTGTDSDFSVKQDIVEITDWSGYSGSFVQHPELTGLDCIRPCFWVELIRGRPKESTIWTSGSSISFCGVNSDTVSWSWPDGAELPFTIDK

SEQ ID NO: 25987 - protein, 449 aa, Artificial Sequence
  neuraminidase__InfluenzaA__AJK00167
MNPNQKIITIGSICMVIGIVSLMLQIGNMISIWVSHSIQTGNQHQAEPIRNANFLTENAVASVTLAGNSSLCPVRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELNAPNYHYEECSCYPDAGEITCVCRDNWHGSNRPWVSFNQNLEYQIGYICSGVFGDNPRPNDGTGSCGPVSPNGAYGIKGFSFKYGNGVWIGRTKSTNSRSGFEMIWDPNGWTETDSNFSVKQDIVAITDWSGYSGSFVQHPELTGLDCIRPCFWVELIRGRPKESTIWTSGSSISFCGVNSDTVSWSWPDGAELPFTIDK

SEQ ID NO: 25988 - protein, 449 aa, Artificial Sequence
  neuraminidase__InfluenzaA__AJK00178
MNPNQKIITIGSICMVIGIVSLMLQIGNMISIWASHSIRTGNQNQVEPIINTNFPTEKAAASITLAGNSSLCPIRGWAIHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKTWRNNILRTQESECACVNGSCFTVMTDGPSDGQASYKIFKMEKGKVIKSVELDAPNYHYEECSCYPDAGEITCVCRDNWHGSNRPWVSFNQNLEYQIGYICSGVFGDNPRPTDGTGSCGPVSHNGAYGVKGFSFKYGNGVWIGRTKSPNSRSGFEMIWDPNGWSETDSSFSVKQDIVAITDWSGYSGSFVQHPELTGLDCIRPCFWVELIRGRPKESTVWTSGSSISFCGVNSDTVSWSWPDGAELPFTIDK

SEQ ID NO: 25989 - protein, 449 aa, Artificial Sequence
  neuraminidase__InfluenzaA__AJK00199
MNPNQKIITIGSICMVIGIVSLMLQIGNMISIWVSHSIQTGNQNQVEPIINTNFLTEKAVVSITLAGNSSLCPIRGWAIHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAAAVLKYNGIITDTIKSWRNNILRTQESECACVNGSCFTVMTDGPSDGQASYKIFKMEKGKVIKSVELDAPNYHYEECSCYPDAGEITCVCRDNWHGSNRPWVSFNQNLEYQIGYICSGVFGDNPRPNDGTGSCSPVSHNGAYGVKGFSFKYGNGVWIGRTKSPNSRSGFEMIWDPNGWSETDSSFSVKQDIVAITDWSGYSGSFVQHPELTGLDCIRPCFWVELIRGRPKESTVWTSGSSISFCGVNSDTVSWSWPDGAELPFTIDK

SEQ ID NO: 25990 - protein, 449 aa, Artificial Sequence
  neuraminidase__InfluenzaA__AJK00208
MNPNQKIITIGSICMVTGIVSLMLQIGNIISMWVSHSIQTRNQHQTEPIRNTNFLTENAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELNAPNYHYEECSCYPDAGEIICVCRDNWHGSNRPWVSFNQNLEYQIGYICSGVFGDNPRPNDGTGSCGPVSPNGAYGIKGFSFKYGNGVWIGRTKSTNSRSGFEMIWDPNGWTGTDSDFSVKQDIVEITDWSGYSGSFVQHPELTGLDCIRPCFWVELIRGRPKESTIWTSGSSISFCGVNSDTVSWSWPDGAELPFTIDK

SEQ ID NO: 25991 - protein, 449 aa, Artificial Sequence
  neuraminidase__InfluenzaA__AJK00219
MNPNQKIITIGSICMVTGIVSLMLQIGNIISMWVSHSIQTRNQHQAEPIRNTNFLTENAVASVTLAGNLSLCPIRGWAVHSKDNNIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELNAPNYHYEECSCYPDAGEIICVCRDNWHGSNRPWVSFNQNLEYQIGYICSGVFGDNPRPNDGTGSCGPVSPNGAYGIKGFSFKYGNGVWIGRTKSTNSRSGFEMIWDPNGWTGTDSDFSVKQDIVEITDWSGYSGSFVQHPELTGLDCIRPCFWVELIRGRPKESTIWTSGSSISFCGVNSDTVSWSWPDGAELPFTIDK

SEQ ID NO: 25992 - protein, 449 aa, Artificial Sequence
  neuraminidase__InfluenzaA__AJK00230
MNPNQKIITIGSICMVTGIVSLMLQIGNIISMWVSHSIQTRNQHQTEPIRNTNFLTENAVASVTLAGNSSLCPIRGWAVHSKDNSIRIGSKGDVFVIREPFISCSHLECRTFFLTQGALINDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELNAPNYHYEECSCYPDAGEIICVCRDNWHGSNRPWVSFNQNLEYQIGYICSGVFGDNPRPNDGTGSCGPVSPNGAYGIKGFSFKYGNGVWIGRTKSTNSRSGFEMIWDPNGWTGTDSDFSVKQDIVEITDWSGYSGSFVQHPELTGLDCIRPCFWVELIRGRPKESTIWTSGSSISFCGVNSDTVSWSWPDGAELPFTIDK

SEQ ID NO: 25993 - protein, 459 aa, Artificial Sequence
  neuraminidase__InfluenzaA__AJS18470
MNPNQKITCISATGVTLSVVSLLIGIANLGLNIGLHYKVDDSTTINIPNMNETNPTITNITNIIVNKNEERTFLNLTKPLCEVNSWHILSKDNAIRIGEDAHILVTREPYLSCDPQGCRMFALSQGTTLRGRHANGTIHDRSPFRALISWEMGQAPSPYNTRVECIGWSSTSCHDGISRMSICISGPNNNASAVVWYRGRPVTEIPSWVGNILRTQESECVCHKGICPVVMTDGPANNKAATKIIYFKEGKIQKIEELQGNAQHVEECSCYGAAGMIKCVCRDNWKGANRPIITIDPEMMTHTSKYLCSKILTDTSRPNDPTNGNCDAPIIGGSPDPGVKGFAYLDGENSWLGRTISKDSRSGYEMLKVPNAETDTQSGPTSYQLIVNNQNWSGYSGAFIDYWANKGCFNPCFYVELIRGRPKEIDVLWTSNSMVALCGSRERLGSWSWHDGAEIIYFK

SEQ ID NO: 25994 - protein, 459 aa, Artificial Sequence
  neuraminidase__InfluenzaA__AJS18481
MNPNQKITCISATGVTLSVVSLLIGIANLGLNIGLHYKVSDSTTINSPNMNETNPTTTNITNIIVNKNEERTFLNLTKPLCEVNSWHILSKDNAIRIGEEAHILVTREPYLSCDPQGCRMFALSQGTTLRGRHANGTIHDRSPFRALISWEMGQAPSPYNTRVECIGWSSTSCHDGISRMSICISGPNNNASAVVWYRGRPVTEIPSWAGNILRTQESECVCHKGICPVVMTDGPANNKAATKIIYFREGKIQKIEELQGNAQHIEECSCYGAAGMIKCACRDNWKGANRPIITIDPEMMTHTSKYLCSKILTDTSRPNDPTNGNCDAPVTGGSPDPGIKGFAFLDGENSWLGRTISKNSRSGYEMLKVPNAETDTQSGPTSYQLIVNNQNWSGYSGAFIDYWANKECFNPCFYVELIRGRPKESDVLWTSNSMVALCGSRERLGSWSWHDGAEIIYFK

SEQ ID NO: 25995 - protein, 469 aa, Artificial Sequence
  neuraminidase__InfluenzaA__AKA59350
MNPNQKIITIGSVCMTIGVANLILQIGNIISIWISHSIQLGNQNQIETCNQSVITYENNTWVNQTDVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECVCVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTVWTSGSSISFCGVNSDTVGWSWPDGAELPFTIDK

SEQ ID NO: 25996 - protein, 469 aa, Artificial Sequence
  neuraminidase__InfluenzaA__AKA59352
MNPNQKIITIGSVCMTIGMANLMLQIGNIISIWISHSIQLGNQNQIETCNQSVITYENNTWVNQTYVNISNTNLAVGQSVVSTKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 25997 - protein, 469 aa, Artificial Sequence
  neuraminidase__InfluenzaA__AKA59354
MNPNQKIITIGSVCMTIGVANLILQIGNIISIWISHSIQLGNQNQIETCNQSVITYENNTWANQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECVCVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTETDNNFSIKQDIVGINEWSGYSGSFVQHPELTGLDCIRPCFWVELIRGRPKENTVWTSGSSISFCGVNSDTVGWSWPDGAELPFTIDK

SEQ ID NO: 25998 - protein, 459 aa, Artificial Sequence
  neuraminidase__InfluenzaA__AKS48026
MNPNQKITCISATGVTLSVVSLLIGIANLGLNIGLHYKVSDSTTINIPNMNETNPTTTNITNIIVNKNEERTFLNLTKPLCEVNSWHILSKDNAIRIGEDAHILVTREPYLSCDPQGCRMFALSQGTTLRGRHANGTIHDKSPFRALISWEMGQAPSPYNTRVECIGWSSTSCHDGISRMSICISGPNNNASAVVWYRGRPVTEIPSWVGNILRTQESECVCHKGICPVVMTDGPANNKAATKIIYFKEGKIQKIEELQGNAQHIEECSCYGAAGMIKCVCRDNWKGANRPIITIDPEMMTHTSKYLCSKILTDTSRPNDPTNGNCDEPITGGSPDPGVKGFAFLDGENSWLGRTISKDSRSGYEMLKVPNAETDTQSGPTSYQLIVNNQNWSGYSGAFIDYWANKECFNPCFYVELIRGRPKEIDVLWASNSMVALCGSRERLGSWSWHDGAEIIYFK

SEQ ID NO: 25999 - protein, 459 aa, Artificial Sequence
  neuraminidase__InfluenzaA__AKS48040
MNPNQKITCISATGMTLSVVSLLIGIANLGLNIGLHYKVSDSTTINIPNMNETNPTTTNITNIIVNKNEERTFLNLTKPLCEVNSWHILSKDNAIRIGEDAHILVTREPYLSCDPQGCRMFALSQGTTLRGRHANGTIHDRSPFRALISWEMGQAPSPYNTRVECIGWSSTSCHDGISRMSICISGPNNNASAVVWYRGRPVTEIPSWVGNILRTQESECVCHKGICPVVMTDGPANNKAATKIIYFKEGKIQKIEELQGNAQHIEECSCYGAAGMIKCVCRDNWKGANRPIITIDPEMMTHTSKYLCSKILTDTSRPNDPTNGNCDAPITGGSPDPGVKGFAFLDGENSWLGRTISKDSRSGYEMLKVPNAETDTQSGPTSYQLIVNNQNWSGYSGAFIDYWANKECFNPCFYVELIRGRPKEIDVLWASNSMVALCGSRERLGSWSWHDGAEIIYFK

SEQ ID NO: 26000 - protein, 459 aa, Artificial Sequence
  neuraminidase__InfluenzaA__ALO75898
MNPNQKITCISATGVTLSVVSLLIGIANLGLNIGLHYKVSDSTTINIPNMNETNPTTTNITNIIVNKNEERTFLNLTKPLCEVNSWHILSKDNAIRIGEDAHILVTREPYLSCDPQGCRMFALSQGTTLRGRHANGTIHDRSPFRALISWEMGQAPSPYNTRVECIGWSSTSCHDGISRMSICISGPNNNASAVVWYRGRPVTEIPSWVGNILRTQESECVCHKGICPVVMTDGPANNKAATKIIYFKEGKIQKIEELQGNAQHIEECSCYGAAGMIKCVCRDNWKGANRPIITIDPEMMTHTSKYLCSKILTDTSRPNDPTNGNCDAPITGGSPDPGVKGFAFLDGENSWLGRTISKDSRSGYEMLKVPNAETDTQSGPTSYQLIVNNQNWSGYSGAFIDYWANKECFNPCFYVELIRGRPKEIDVLWASNSMVALCGSRERLGSWSWHDGAEIIYFK

SEQ ID NO: 26001 - protein, 459 aa, Artificial Sequence; identical to SEQ ID NO: 26000
  neuraminidase__InfluenzaA__ALO75910

SEQ ID NO: 26002 - protein, 459 aa, Artificial Sequence
  neuraminidase__InfluenzaA__ALO75922
MNPNQKITCISATGVTLSVVSLLIGIANLGLNIGLHYKVSDSTTINIPNMNETNPTTTNITNIIVNKNEERTFLNLTKPLCEVNSWHILSKDNAIRIGEDAHILVTREPYLSCDPQGCRMFALSQGTTLRGRHANGTIHDRSPFRALISWEMGQAPSPYNTRVECIGWSSTSCHDGISRMSICISGPNNNASAVVWYRGRPVTEIPSWVGNILRTQESECVCHKGICPVVMTDGPANNKAATKIIYFKEGKIQKIEELQGNAQHIEECSCYGAAGMIKCVCRDNWKGANRPIITIDPEMMTHTSKYLCSKILTDTSRPNDPTNGNCDEPITGGSPDPGVKGFAFLDGENSWLGRTISKDSRSGYEMLKVPNAETDTQSGPTSYQLIVNNQNWSGYSGAFIDYWANKECFNPCFYVELIRGRPKEIDVLWASNSMVALCGSRERLGSWSWHDGAEIIYFK

SEQ ID NO: 26003 - protein, 466 aa, Artificial Sequence
  neuraminidase__InfluenzaA__ALT20083
MNPNQRITAIGSVSLIIAIICLLMQIAILTTTMTLHFRQNECSNPSNNQVMPCEPIIIERNTVHLNSTTIEREICPKVAEYKNWSKPQCQITGFAPFSKDNSIRLSASGDIWVTREPYVSCSLNKCYQFALGQGTTLKNKHSNGTTHDRTPHRTLLMNELGVPFHLGTKQVCIAWSSSSCYDGKAWLHVCVTGDDKNATASIIYDGMLVDSIGSWSKNILRTQESECVCINGTCAVVMTDGSASGKADTRVLFIREGKIINISPLSGSAQHVEECSCYPRYPEVRCVCRDNWKGSNRPILYINMADYSIESSYVCSGLVGDTPRNDDSSSSSNCRDPNNERGAPGVKGWAFDDGNDVWMGRTIKNGSRSGYETFRVVNGWTMANSKSQINRQVIVDSNDWSGYSGIFSVEGKKCINRCFYVELIRGRPQEPRVWWTSNSIIVFCGTSGTYGTGSWPDGANINFMPI

SEQ ID NO: 26004 - protein, 469 aa, Artificial Sequence
  neuraminidase__InfluenzaA__AMA65392
MNPNQKIITIGSVCMTIGMANLILQIGNIISIWVSHSIQIGNQSQIETCNQSVITYENNTWVNQTYVNISNTNFAAGQSVVSVKLAGNSSLCPVSGWAIYSKDNSVRIGSRGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIIKSVEMKAPNYHYEECSCYPDSSEITCVCRDNWHGSNRPWVSFNQNLEYQMGYICSGVFGDNPRPNDKTGSCGPVSSNGANGVKGFSFKYGNGVWIGRTKSISSRKGFEMIWDPNGWTGTDNKFSIKQDIVGINEWSGYSGSFVQHPELTGLDCIRPCFWVELIRGRPEENTIWTSGSSISFCGVNSDTVGWSWPDGAELPFTIDK

SEQ ID NO: 26005 - protein, 469 aa, Artificial Sequence
  neuraminidase__InfluenzaA__AMA65394
MNPNQKIITIGSVCMTIGMANLILQIGNIISIWVSHSIQIGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIIKSVEMKAPNYHYEECSCYPDSSEITCVCRDNWHGSNRPWVSFNQNLEYQMGYICSGVFGDNPRPNDKTGSCGPVSSNGANGVKGFSFKYGNGVWIGRTKSISSRKGFEMIWDPNGWTGTDNKFSIKQDIVGINEWSGYSGSFVQHPELTGLDCIRPCFWVELIRGRPEENTIWTSGSSISFCGVNSDTVGWSWPDGAELPFTIDK

SEQ ID NO: 26006 - protein, 469 aa, Artificial Sequence
  neuraminidase__InfluenzaA__BAA00618
MNPNQKIITMGSVSIIIAIVCLLMQIAILVTTVTLHFRQHESDSPPSNQVIPCEPIIIERNITEIVYLNNTTIEKETCPKSVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYNGRLVDSIGSWSQNILRTQESECVCINGTCTVVMTDGSASGRADTRILFIEEGKIVHISPLSGSAQHVEECSCYPRYPDVRCICRDNWKGSNSPVVDINMKDYSIDSSYVCSGLVGDTPRNDDRSSKSNCRNPNNERGNHGVKGWAFDNGDDVWMGRTISKDLRSGYETFKVIGGWSTPNSKSQTNRQVIVDSNNWSGYSGIFSVEGKSCINRCFYVELIRGRKQETRVWWTSNSIVVFCGTSGTYGTGSWPDGANIDFMPI

SEQ ID NO: 26007 - protein, 469 aa, Artificial Sequence
  neuraminidase__InfluenzaA__BAA00619
MNPNQKIITIGSVSLTFAAICFLMQIAILVTTVTLNFKQYECDPPATNQVMPCEPIIIERNITEIVYLTNTTIEREICPKLVEYRNWSKPQCKITGFAPFSKDNSIRLSAGGDIWVTREPYVSCDPGRCYQFALGQGTTLDNKHSNDTIHDRTPHRTLLMNELGVPFHLGTRQVCIAWSSSSCHDGKAWLHVCITGYDKNATASFIYDGRLVDSIGSWSKNILRTQESECVCINGTCTVVMTDGSASGRADTRILFIEEGRIVHISPLSGSAQHVEECSCYPRYPGVRCICRDNWKGSNRPVVDINVKDYSINSSYVCSGLVGDTPRNNDRSSNSYCQNPNNEKGNHGVKGWAFDDGNDVWMGRTISEDSRSGYQTFKVIGGWSTPNSKLQINRQVIVDSDNRSGYSGIFSVEGKSCINRCFYVELIRGRRQETRVWWTSNSIVVFCGTSGTYGTGSWPDGADINLMPI

SEQ ID NO: 26008 - protein, 469 aa, Artificial Sequence
  neuraminidase__InfluenzaA__BAA00620
MNPNQKIMTIGSVSLIIAAVCFLMQIAILVTTVTLHFKQCECDSPSNNQVKPCEPIIIERNITEIVYLNNTTIEKETCPKLVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPNVRCICRDNWKGSNRPIVDINMKDYSIDSSYVCSGLVGDTPRNDDRSSKSNCRNPNNEKGNHGVKGWAFDNGDDVWMGRTISKDLRSGYETFKVIGGWFTPNSKSQVNRQVIVDSDNRSGYSGIFSVEGKSCINRCFYVELIRGRGQETRVWWTSNSIVVFCGTSGTYGKGSWPDGANINFMPI

SEQ ID NO: 26009 - protein, 469 aa, Artificial Sequence
  neuraminidase__InfluenzaA__BAA00621
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHTSPLSGSAQHVEECSCYPRYPGVRCICRDNWKGSNRPVVDINVKDYSIDSSYVCSGLVGDTPRKNDRSSSSYCRNPNNEKGTHGVKGWAFDDGNDVWMGRTISEDSRSGYETFKVIGGWSTPNSKLQINRQVIVDSNDRSGYSGIFSVEGKSCINRCFYVELIRGREQETRVWWTSNSIVVFCGTSGTYGTGSWPDGADINLMPI

SEQ ID NO: 26010 - protein, 470 aa, Artificial Sequence
  neuraminidase__InfluenzaA__BAA06714
MNPNQKIITIGSISMAIGIISLILQIGNIISIWVSHSIQTGSQNHTGICNQRIITYENSTWVNQTYVNINNTNVVAGKDKTSVTLAGNSSLCPIRGWAIYTKDNSIRIGSKGDVFVIREPFISCSHLECRTFFLTQGALLNDKHSNGTVKDRSPYRRLMSCPLGEAPSPYNSRFESIAWSASACHDGMGWLTIGISGPDDGAVAVLKYNGIITETIKSWKKRILRTQESECVCVNGSCFTIMTDGPSNGQASYRIFKIEKGKVTKSIELDAPNSHYEECSCYPDTGTVMCVCRDNWHGSNRPWVSFNQNLDYQIGYICSGVFGDNPPPKDGKGSCDPVTVDGADGVKGFSYRYGNGVWIGRTKSNRFRKGFEMIWDPNGWTDTDSDFLVKQDVVAMTDWSGYSGSFVQHPELTGLDCMRPCFWVELVRGRPRENTTIWTSGSSISFCGVNSDTANWSWPDGAELPFTIDK

SEQ ID NO: 26011 - protein, 470 aa, Artificial Sequence
  neuraminidase__InfluenzaA__BAA06715
MNPNQKIITIGSISMAIGIISLILQIGNIISIWASHSIQTGSQNHTGICNQRIITYENSTWVNQTYVNINNTNVVAGKDKTSVTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGMGWLTIGISGPDNGAVAVLKYNGIITETIKSWKKRILRTQESECVCVNGSCFTIMTDGPSNGAASYRIFKIEKGKVTKSIELDAPNYHYEECSCYPDTGTVMCVCRDNWHGSNRPSVSFNQNLDYQIGYICSGVFGDNPRPKDGEGSCNPVTVDGADGVKGFSYRYGNGVWIGRTKSNRLRKGFEMIWDPNGWTDTDSDFSVKQDVVAMTDWSGYSGSFVQHPELTGLDCMRPCFWVELIRGRPREKTTIWTSGSSISFCGVNSDTANWSWPDGAELPFTIDK

SEQ ID NO: 26012 - protein, 469 aa, Artificial Sequence
  neuraminidase__InfluenzaA__BAA06716
MNTNQRIITIGTICLIVGIISLLLQIGNIILLWMSHSIQTGEKSHPKVCNQSVITYENNTWVNQTYVNISNTNIAAGQGVTPIILAGNSSLCPISGWAIYSKDNSIRIGSKGDIFVMREPFISCSHLECRTFFLTQGALLNDRHSNGTVKDRSPYRTLMSCPIGEAPSPYNSRFESVAWSASACHDGMGWLTIGISGPDNGAVAVLKYNGIITDTIKSWRNKILRTQESECVCINGSCFTIMTDGPSNGQASYKLFKMEKGKIIKSIELDAPNYHYEECSCYPDTGKVVCVCRDNWHASNRPWVSFDQNLDYQIGYICSGVFGDNPRSNDGKGNCGPVLSNGANGVKGFSFRYGNGVWIGRTKSISSRRGFEMIWDPNGWTETDSSFSMKQDIIALTDWSGYSGSFVQHPELTGMNCIRPCFWVELIRGQPKESTIWTSGSSISFCGVNSGTASWSWPDGADLPFTIDK

SEQ ID NO: 26013 - protein, 470 aa, Artificial Sequence
  neuraminidase__InfluenzaA__BAA06717
MNPNQKIITIGSISMAIGIISLILQIGNIISIWASHSIQTGSQNHTGICNQRMITYENSTWVNQTYVNISNTNVVAGKDKTSVTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGMGWLTIGISGPDDGAVAVLKYNGIITETIKSWRKQILRTQESECVCVNGSCFTIMTDGPSDGPASYRIFKIEKGKVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSVKQDVVAMTDWSGYSGSFVQHPELTGLDCMRPCFWVELIRGRPREKTTIWTSGSSISFCGVNSDTANWSWPDGAELPFTIDK

SEQ ID NO: 26014 - protein, 470 aa, Artificial Sequence
  neuraminidase__InfluenzaA__BAA06718
MNPNQKIITIGSICMAIGIISLILQIGNIVSIWISHSIQTGSQNYTGICNQRIITYENSTWVNQTYVNINNTNVVAGQDTTSVALAGNSSLCPISGWAIYSKDNSIRIGSKGDVFVIREPFISCSHLECRTFFLTQGALLNDKHSNGTVKDRSPYRRLMSCPIGEAPSPYNSRFESVAWSASACHDGMGWLTIGISGPDDGAVAVLKYNGIITETIKSWRKRILRTQESECVCVNGSCFTIMTDGPNNGPASYRIFKIEKGKITKSIELDAPNSHYEECSCYPDAGTVMCVCRDNWHGSNRPWVSFNQNLDYQIGYICSGVFGDNPRPKDGKGSCDPVTVDGADGVKGFSYRYGNGVWIGRTKSNSSRRGFEMIWDPNGWTDTDSKFLVKQDVVAMTDWSGYSGSFVQHPELTGLDCMRPCFWVELVRGRPRENTTIWTSGSSISFCGVNGDTANWSWPDGAELPFTIDK

SEQ ID NO: 26015 - protein, 470 aa, Artificial Sequence
  neuraminidase__InfluenzaA__BAA06720
MNPNQKIITIGSISMAIGIISLILQIGNIISIWVSHSIQTGSQNHTGICNQRIITYENSTWVNQTYVNINNTNVVAGKDKTSVTLAGNSSLCPILGWAIYTKDNSIRIGSKGDVFVIREPFISCSHLECRTFFLTQGALLNDKHSNGTVKDRSPYRRLMSCPLGEAPSPYNSRFESVAWSASACHDGMGWLTIGISGPDDGAVAVLKYNGIITETIKSWKKRILRTQESECVCVNGSCFTIMTDGPSNGAASYRIFKIEKGKVTKSIELDAPNSHYEECSCYPDTGTVMCVCRDNWHGSNRPWVSFNQNLDYQIGYICSGVFGDNPPPKDGKGSCNPVTVDGADGVKGFSYRYGNGVWIGRTKSNRFRKGFEMIWDPNGWTDTDSDFSVKQDVVAMTDWSGYSGSFVQHPELTGLDCMRPCFWVELVRGRPRENTTIWTSGSSISFCGVNSDTANWSWPDGAELPFTIDK

SEQ ID NO: 26016 - protein, 469 aa, Artificial Sequence
  neuraminidase__InfluenzaA__BAD16637
MNPNQKIITIGSVSLTIATVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTISKDSRSGYETFKVIGGWSTPNSKSQVNRQVIVGNNNWSGYSGIFSVEGKSCINRCFYVELIRGMPQETRVWWTSNSIVVFCGTSGTYGTGSWPDGANINFMPI

SEQ ID NO: 26017 - protein, 469 aa, Artificial Sequence
  neuraminidase__InfluenzaA__BAD16638
MNPNQKIITIGSVSLTIATVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTHESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTINKDSRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 26018 - protein, 469 aa, Artificial Sequence; identical to SEQ ID NO: 23197
  neuraminidase__InfluenzaA__BAD16639

SEQ ID NO: 26019 - protein, 469 aa, Artificial Sequence
  neuraminidase__InfluenzaA__BAD16640
MNPNQKIITIGSVSLTIATVCFLMQIAILVTTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCVAWSSSSCHDGKAWLHVCVTGDDKNATASFIYDGRLMDSIGSWSQNILRTQESECVCINGTCTVVMTDGSASGRADTRILFIEEGKIVHISPLSGSAQHVEECSCYPRYPDVRCICRDNWKGSNRPVIDINMEDYSIDSSYVCSGLVGDTPRNDDRSSNSNCRNPNNERGNPGVKGWAFDNGDDVWMGRTISKDLRSGYETFKVIGGWSTPNSKSQINRQVIVDSNNWSGYSGIFSVEGKSCINRCFYVELIRGRQQETRVWWTSNSIVVFCGTSGTYGTGSWPDGANINFMPI

SEQ ID NO: 26020 - protein, 469 aa, Artificial Sequence
  neuraminidase__InfluenzaA__BAD16641
MNPNQKIITIGSASLTIATVCFLMQIAILVTTVTLHFKQHECDSPASNQVMPCEPIIIERNTTEIVYLNNTTIEKEICPKVVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPDVRCICRDNWKGSNRPVVDINMEDYSIDSSYVCSGLVGDTPRNDDRSSNSNCRNPNNEKGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINLMPI

SEQ ID NO: 26021 - protein, 469 aa, Artificial Sequence
  neuraminidase__InfluenzaA__BAD16642
MNPNQKIITIGSVSLTIATVCFLMQIAILVTTVTLHFKQYECDSPASNQVMPCEPIIIERNITEIVYLNNTTIDKEKCPKVVEYRNWSKPQCQITGFAPFSKDNSIRLSAGGDIWVTREPYVSCDHGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 26022 - protein, 469 aa, Artificial Sequence
  neuraminidase__InfluenzaA__BAD16643
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHISPLSGSAQHVEECSCYPRYPGVRCICRDNWKGSNRPVVDINVKDYSIDSSYVCSGLVGDTPRNNDRSSNSYCRNPNNEKGNHGVKGWAFDDGNDVWMGRTISEDSRSGYETFKVIGGLFTPNSKLQINRQVIVDSDNRSGYSGIFSVEGKSCINRCFYVELIRGREQETRVWWTSNSIVVFCGTSGTYGTGSWPDGADINLMPI

SEQ ID NO: 26023 - protein, 469 aa, Artificial Sequence
  neuraminidase__InfluenzaA__BAD16644
MNPNQKIITIGSVSLTIATICFLMQIAILVTTVTLHFKQYECDSPPNNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSRSSCHDGKAWLHVCVTGYDKNATASFIYDGRLVDSIGSWSKNILRTQESECVCINGTCTVVMTDGSASGRADTKILFIEEGKIVHISPLSGSAQHVEECSCYPRYPGVRCICRDNWKGSNRPVVDINVKDYSIDSSYVCSGLVGDTPRNNDRSSNSYCRNPNNEKGNHGVKGWAFDDGNDVWMGRTISEDSRSGCETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 26024 - protein, 469 aa, Artificial Sequence; identical to SEQ ID NO: 14576
  neuraminidase__InfluenzaA__BAD16645

SEQ ID NO: 26025 - protein, 469 aa, Artificial Sequence; identical to SEQ ID NO: 22544
  neuraminidase__InfluenzaA__BAD16646

SEQ ID NO: 26026 - protein, 469 aa, Artificial Sequence; identical to SEQ ID NO: 14576
  neuraminidase__InfluenzaA__BAD16647

SEQ ID NO: 26027 - protein, 469 aa, Artificial Sequence
  neuraminidase__InfluenzaA__BAD16648
MNPNQKIITIGSVSLTIATICFLMQIAILVTTVTLHFKQYECSSPPNNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPYRTLLMNELGVPFHLGTRQVCIAWSSSSCHDGKAWLHVCVTGYDKNATASFIYDGRLVDSIGSWSKNILRTQESECVCIYGTCTVVMTDGSASERAETKILFIEEGKIVHISPLSGSAQHVEECSCYPRYPGVRCVCRDNWKGSNRPVVDINVKDYSIVSSYVCSGLVGDTPRKNDRSSSSYCRNPNNEKGNHGVKGWAFDDGNDVWMGRTISEESRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 26028 - protein, 469 aa, Artificial Sequence
  neuraminidase__InfluenzaA__BAE07203
MNPNQKITTIGSICMVIGIVSLMLQIGNIISIWVSHSIQTGNQHQAEPCNQSIITYENNTWVNQTYVNISNTNFLTEKAVASVTLAGNSSLCPISGWAVYSKDNGIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNIMRTQESECACVNGSCFTVMTDGPSNGQASYKIFRIEKGKVVKSAELNAPNYHYEECSCYPDAGEITCVCRDNWHGSNRPWVSFNQNLEYRIGYICSGVFGDNPRPNDGTGSCGPVSPKGAYGIKGFSFKYGNGVWIGRTKSTNSRSGFEMIWDPNGWTGTDSNFSVKQDIVAITDWSGYSGSFVQHPELTGLDCIRPCFWVELIRGRPKESTIWTSGSSISFCGVNSDTVGWSWPDGAELPFTIDK

SEQ ID NO: 26029 - protein, 469 aa, Artificial Sequence
  neuraminidase__InfluenzaA__BAF46322
MNPNPKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26030 - protein, 469 aa, Artificial Sequence; identical to SEQ ID NO: 14714
  neuraminidase__InfluenzaA__BAF46323

SEQ ID NO: 26031 - protein, 469 aa, Artificial Sequence
  neuraminidase__InfluenzaA__BAF46324
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDIVHDRTPYRTLLMNELGVPFHLGTKQVCIAWSSSSCHDGKAWLHVWVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26032 - protein, 469 aa, Artificial Sequence
  neuraminidase__InfluenzaA__BAF46332
MNPNQKIITIGSVSLTISTICFFMQIAILITTVTLHFKQYEFNSPPNNQVMLCEPTIIERNITEIVYLTNTTIEKEICPKLAEYRKWSKPQCNITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAHHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26033 - protein, 469 aa, Artificial Sequence
  neuraminidase__InfluenzaA__BAF46334
MNPNQKIITIGSVSLTISTICFFMQIAILITTVTLHFKQYEFNSPPNNQVMLCEPTIIERNITEIVYLTNTTIEKEICPKLAEYRKWSKPQCNITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26034 - protein, 469 aa, Artificial Sequence; identical to SEQ ID NO: 26033
  neuraminidase__InfluenzaA__BAF46335

SEQ ID NO: 26035 - protein, 469 aa, Artificial Sequence
  neuraminidase__InfluenzaA__BAF46337
MNPNQKIITIGSVSLTISTICFFMQIAILITTVTLHFKQYEFNSPPNNQVMLCEPTIIERNITEIVYLTNTTIEKEICPKLAEYRKWSKPQCNITGFAPFSKDNSIRLSAGGDIWVTREPYVSCDPDKCYQFALGQGTTLNNVHSNDTVRVRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMARTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26036 - protein, 469 aa, Artificial Sequence; identical to SEQ ID NO: 26033
  neuraminidase__InfluenzaA__BAF46345

SEQ ID NO: 26037 - protein, 469 aa, Artificial Sequence
  neuraminidase__InfluenzaA__BAF46346
MNPNQKIITIGSVSLTISTICFFMQIAILITTVTLHFKQYEFNSPPNNQVMLCEPTIIERNITEIVYLTNTTIEKEICPKLAEYRKWSKPQCNIAGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVICVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26038 - protein, 469 aa, Artificial Sequence
  neuraminidase__InfluenzaA__BAF46347
MNPNQKIITIGSVSLTISTICFFMQIAILITTVTLHFKQYEFNSPPNNQVMLCEPTIIERNITEIVYLTNTTIEKEICPKLAEYRKWSKPQCNITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCVTGDDKNATATFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26039 - protein, 469 aa, Artificial Sequence
  neuraminidase__InfluenzaA__BAF46349
MNPNQKIITIGSVSLTISTICFFMQIAILITTVTLHFKQYEFNSPPNNQVMLCEPTIIERNITEIVYLTNTTIEKEICPKLAEYRKWSKPQCNITGFAPFSKDNSIRLSAGGDIWVTREPYVSCDPDKCYQFALGQGTTLNNVHSNDTVRARTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVFEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26040 - protein, 469 aa, Artificial Sequence; identical to SEQ ID NO: 26033
  neuraminidase__InfluenzaA__BAF46350

SEQ ID NO: 26041 - protein, 469 aa, Artificial Sequence
  neuraminidase__InfluenzaA__BAF46351
MNPIQKIITIGSVSLTISTICFFMQIAILITTVTLHFKQYEFNSPPNNQVMLCEPTIIERNITEIVYLTNTTIEKEICPKLAEYRKWSKPQCNITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPMVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26042 - protein, 469 aa, Artificial Sequence
  neuraminidase__InfluenzaA__BAF46368
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVRERTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26043 - protein, 469 aa, Artificial Sequence
  neuraminidase__InfluenzaA__BAF46369
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGKLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKSRSGYETFQVIEGWSNSNSKLQINRQVIVDRGNRSGYSGIFSVEGKSCINRCFYVELIRGRKEETEVLWTSNSIVVFCGTSGTYGTGSWPDGADINLMPI

SEQ ID NO: 26044 - protein, 469 aa, Artificial Sequence
  neuraminidase__InfluenzaA__BAF46370
MNPNQKIITIGSVSLTISTICFFMQIAILITTVTLHFKQYEFNSLPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSTSIVVFCGSSGTYGTGSWPDGADINLMPI

SEQ ID NO: 26045 - protein, 469 aa, Artificial Sequence
  neuraminidase__InfluenzaA__BAF46371
MNPNQKIITIGSVSLTISTICFFMQIAILITTVTLHFKQYEFNSPPNNQVMLCEPTIIERNITEIVHLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQTNRQVIVDRSNRSGYSGIFSVEGKSCINRCFYVELIRGRKEETEVLWTSNSIVVFCGTSGTYGTGSWPDGADINLMPI

SEQ ID NO: 26046 - protein, 469 aa, Artificial Sequence
  neuraminidase__InfluenzaA__BAF46372
MNPNQKIITIGSVSLTISTICFFMQIAILITTVTLHFKQYEFNSPPNNQVMLCEPTIIERNITEIVYLTNTTIEKEICPKLAEYRNWSKPQCDIAGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26047 - protein, 469 aa, Artificial Sequence
  neuraminidase__InfluenzaA__BAF46385
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCPDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGARCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQTNRQVIVDRGNRSGYSGIFSVEGKSCINRCFYVELIRGRKEETEVLWTSNSIVVFCGTSSTYGTGSWPDGADINLMPI

SEQ ID NO: 26048 - protein, 469 aa, Artificial Sequence
  neuraminidase__InfluenzaA__BAF46386
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQTNRQVIVDRGNRSGYSGIFSVEGKSCINRCFYVELIRGRKEETEVLWTSNSIVVFCGTSSTYGTGSWPDGADINLMPI

SEQ ID NO: 26049 - protein, 469 aa, Artificial Sequence; identical to SEQ ID NO: 16564
  neuraminidase__InfluenzaA__BAF46387

SEQ ID NO: 26050 - protein, 469 aa, Artificial Sequence
  neuraminidase__InfluenzaA__BAF46388
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQDIVDRGNRSGYSGIFSVEGKSCINRCFYVELIRGRKEENEVLWTSNSIVVFCGTSGTYGTGSWPDGADINLMPI

SEQ ID NO: 26051 - protein, 469 aa, Artificial Sequence
  neuraminidase__InfluenzaA__BAF47922
MNPNQKIITIGSVSLTISTICFFMQIAILITTVTLHFKQYEFNSPPNIQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIASSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26052 - protein, 469 aa, Artificial Sequence; identical to SEQ ID NO: 14694
  neuraminidase__InfluenzaA__BAF47923

SEQ ID NO: 26053 - protein, 469 aa, Artificial Sequence
  neuraminidase__InfluenzaA__BAF47924
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNSEEGGHGVKGWAFDDGNDVWMGRTISEKLRSGYETFKVIEGWSNPNSKLQTNRQVIVDRGNRSGYSGIFSVEGKSCINRCFYVELIRGRKEETEVLWTSNSIVVFCGTSGTYGTGSWPDGADINLMPI

SEQ ID NO: 26054 - protein, 469 aa, Artificial Sequence; identical to SEQ ID NO: 14712
  neuraminidase__InfluenzaA__BAF47925

SEQ ID NO: 26055 - protein, 469 aa, Artificial Sequence; identical to SEQ ID NO: 14712
  neuraminidase__InfluenzaA__BAF47926

SEQ ID NO: 26056 - protein, 469 aa, Artificial Sequence; identical to SEQ ID NO: 20699
  neuraminidase__InfluenzaA__BAF47927

SEQ ID NO: 26057 - protein, 469 aa, Artificial Sequence; identical to SEQ ID NO: 16564
  neuraminidase__InfluenzaA__BAF47928

SEQ ID NO: 26058 - protein, 469 aa, Artificial Sequence
  neuraminidase__InfluenzaA__BAF47929
MNPNQKIITIGSVSLTISTICFFMQIAILITTVTLHFKQYEFNSPPNNQVMLCEPTIIERNITEIVYLTNTTTEKEICPKLAEYRNWSKPQCNITGFAPFSKDNSIRLSAGGDIWVTREPYVSCDPDKCYQFALGQGTTLNNVHSDDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEENEVLWTSNSIVVFCGTSGTYGTGSWPDGADINLMPI

SEQ ID NO: 26059 - protein, 469 aa, Artificial Sequence
  neuraminidase__InfluenzaA__BAF47930
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHGRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSTVSSYVCSGLVGDTPRKNDSSSSGHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26060 - protein, 469 aa, Artificial Sequence; identical to SEQ ID NO: 20699
  neuraminidase__InfluenzaA__BAF47931

SEQ ID NO: 26061 - protein, 469 aa, Artificial Sequence
  neuraminidase__InfluenzaA__BAF47932
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSGHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26062 - protein, 469 aa, Artificial Sequence; identical to SEQ ID NO: 14712
  neuraminidase__InfluenzaA__BAF47933

SEQ ID NO: 26063 - protein, 469 aa, Artificial Sequence; identical to SEQ ID NO: 14714
  neuraminidase__InfluenzaA__BAF47934

SEQ ID NO: 26064 - protein, 469 aa, Artificial Sequence; identical to SEQ ID NO: 14714
  neuraminidase__InfluenzaA__BAF47935

SEQ ID NO: 26065 - protein, 469 aa, Artificial Sequence
  neuraminidase__InfluenzaA__BAF47936
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSGHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26066 - protein, 469 aa, Artificial Sequence
  neuraminidase__InfluenzaA__BAF47937
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCGPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26067 - protein, 469 aa, Artificial Sequence
  neuraminidase__InfluenzaA__BAF47938
MNPNQKIITIGSVSLTISTICFFMQIAILITTVTLHFKQYEFNSLPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHGRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKTDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26068 - protein, 469 aa, Artificial Sequence; identical to SEQ ID NO: 14714
  neuraminidase__InfluenzaA__BAF47939

SEQ ID NO: 26069 - protein, 469 aa, Artificial Sequence
  neuraminidase__InfluenzaA__BAF47940
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEKTEVLWTSNSIVVFCGTSGTYGTGSWPDGADINLMPI

SEQ ID NO: 26070 - protein, 469 aa, Artificial Sequence; identical to SEQ ID NO: 14712
  neuraminidase__InfluenzaA__BAF47941

SEQ ID NO: 26071 - protein, 469 aa, Artificial Sequence
  neuraminidase__InfluenzaA__BAF47943
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMIELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQTNRQVIVDRGNRSGYSGIFSVEGKSCINRCFYVELIRGRKEETEVLWTSNSIVVFCGTSGTYGTGSWPDGADINLMPI

SEQ ID NO: 26072 - protein, 469 aa, Artificial Sequence
  neuraminidase__InfluenzaA__BAF47944
MNPNQKIITIGSVSLTISTICFFMQIAILITTVTLHFKQYEFNSPPNNQVMLCEPTIIERNITEIVYLTNTTIEKEICPKLTEYRNWSKPQCNITGFAPFSKDNSIRLSAGGDIWVTREPYVSCDPDKCYQFALGQGTTLNNVHSNDPVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQTNRQVIVDRGNRSGYSGIFSVEGKSCINRCFYVELIRGRKEETEVLWTSNSIVVFCGTSGTYGTGSWPDGADINLMPI

SEQ ID NO: 26073 - protein, 469 aa, Artificial Sequence
  neuraminidase__InfluenzaA__BAF47945
MNPNQKIITIGSVSLTISTICFFMQIAILITTVTLHFKQYEFNSPPNNQVKLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQTNRQVIVDRGNRSGYSGIFSVEGKSCINRCFYVELIRGRKEETEVLWTSNSIVVFCGTSGTYGTGSWPDGADINLMPI

SEQ ID NO: 26074 - protein, 469 aa, Artificial Sequence
  neuraminidase__InfluenzaA__BAF47946
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVLEGWSNPNSKLQTNRQVIVDRGNRSGYSGIFSVEGKSCINRCFYVELIRGRKEETEVLWTSNSIVVFCGTSGTYGTGSWPDGADINLMPI

SEQ ID NO: 26075 - protein, 469 aa, Artificial Sequence
  neuraminidase__InfluenzaA__BAF47948
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDKVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNSNSKLQINRQVIVDRGNRSGYSGIFSVEGKSCINRCFYVELIRGRKEETEVLWTSNSIVVFCGTSGTYGTGSWPDGADINLMPI

SEQ ID NO: 26076 - protein, 469 aa, Artificial Sequence
  neuraminidase__InfluenzaA__BAF47949
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDKVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26077 - protein, 469 aa, Artificial Sequence; identical to SEQ ID NO: 14714
  neuraminidase__InfluenzaA__BAF47950

SEQ ID NO: 26078 - protein, 469 aa, Artificial Sequence
  neuraminidase__InfluenzaA__BAF47951
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNSNSKLQINRQVIVDRGNRSGYSGIFSVEGKSCINRCFYVELIRGRKEETEVLWTSNSIVVFCGTSGTYGTGSWPDGADINLMPI

SEQ ID NO: 26079 - protein, 469 aa, Artificial Sequence
  neuraminidase__InfluenzaA__BAF47952
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQTNRQVIVDRGNRSGYSGIFSVEGKSCINRCFYVELIRGRKEETEVLWTSNSIVVFCGTSGTYGTGSWPDGANINLMPI

SEQ ID NO: 26080 - protein, 469 aa, Artificial Sequence
  neuraminidase__InfluenzaA__BAF47953
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26081 - protein, 469 aa, Artificial Sequence; identical to SEQ ID NO: 26033
  neuraminidase__InfluenzaA__BAF47954

SEQ ID NO: 26082 - protein, 469 aa, Artificial Sequence; identical to SEQ ID NO: 26033
  neuraminidase__InfluenzaA__BAF47955

SEQ ID NO: 26083 - protein, 469 aa, Artificial Sequence
  neuraminidase__InfluenzaA__BAF47956
MNPNQKIITIGSVSLTISTICFFMQIAILITTVTLHFKQYEFNSPPNNQVMLCEPTIIERNITEIVYLTNTTIEKEICPKLAEYRKWSKPQCNITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINFMPI

SEQ ID NO: 26084 - protein, 469 aa, Artificial Sequence
  neuraminidase__InfluenzaA__BAF47958
MNPNQKIITIGSVSLTISTICFFMQIAILITTVTLHFKQYEFNSPPNNQVMLCEPTIIERNITEIVYLTNTTIEKEICPKLAEYRKWSKPQCNITGFAPFSKDNSIRLSAGGDIWVTREPYVSCDPDKCYQFALGQGTTLNNVHSNDTVRDRTPYRTLMMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWTDGADINFMPI

SEQ ID NO: 26085 - protein, 469 aa, Artificial Sequence
  neuraminidase__InfluenzaA__BAF47959
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNYTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSGHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26086 - protein, 469 aa, Artificial Sequence
  neuraminidase__InfluenzaA__BAF47960
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHNRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSGHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26087 - protein, 469 aa, Artificial Sequence
  neuraminidase__InfluenzaA__BAF47975
MNPNQKIITIGSVSLTISTICFFMQIAILITTVTLHFKQYEFNSPPNNQVMLCEPTIIERNITEIVYLTNTTIEKEICPKLAEYRKWSKPQCNITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINHMPI

SEQ ID NO: 26088 - protein, 469 aa, Artificial Sequence; identical to SEQ ID NO: 14712
  neuraminidase__InfluenzaA__BAF47976

SEQ ID NO: 26089 - protein, 469 aa, Artificial Sequence
  neuraminidase__InfluenzaA__BAF47977
MNPNQKIITIGSVSLTISTICFFMQIAILITTVTLQFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHGRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQTNRQVIVDRGNRSGYSGIFSVEGKSCINRCFYVELIRGRKEETEVLWTSNSIVVFCGTSGTYGTGSWPDGADINLMPI

SEQ ID NO: 26090 - protein, 469 aa, Artificial Sequence
  neuraminidase__InfluenzaA__BAF47978
MNPNQKIITIGSVSLTISTICFFMQIAILVTTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDAWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26091 - protein, 469 aa, Artificial Sequence
  neuraminidase__InfluenzaA__BAF47979
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHNRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQTNRQVIVDRGNRSGYSGIFSVEGKSCINRCFYVELIRGRKEETEVLWTSNSIVVFCGTSGTYGTGSWPDGADINLMPI

SEQ ID NO: 26092 - protein, 469 aa, Artificial Sequence; identical to SEQ ID NO: 16564
  neuraminidase__InfluenzaA__BAF47980

SEQ ID NO: 26093 - protein, 469 aa, Artificial Sequence
  neuraminidase__InfluenzaA__BAF47981
MNPNQKIITIGSVSLTISTICLFMQIAILITTVTLHFKQYEFNSPPNNQVMLCEPTIIERNITEIVYLTNTTIEKEICPKLAEYRKWSKPQCNITGFAPFSKDNSIRLSAGGDIWVTREPYVSCDPDKCYQFALGQGTTLNNVHSNDTVRNRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26094 - protein, 469 aa, Artificial Sequence
  neuraminidase__InfluenzaA__BAF47982
MNPNQKIITIGSVSLTISTICFFMQIAILITTVTLHFKQYEFNSPPNNQVMLCEPTIIERNITEIVYLTNTTIEKEICPKLAEYRKWSKPQCNITGFAPFSKDNSIRLSAGGDIWVTREPYVSCDPDKCYQFALGQGTTLNNVHSNDTVRNRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26095 - protein, 469 aa, Artificial Sequence; identical to SEQ ID NO: 16564
  neuraminidase__InfluenzaA__BAF47983

SEQ ID NO: 26096 - protein, 469 aa, Artificial Sequence
  neuraminidase__InfluenzaA__BAF47984
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHGRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGDHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26097 - protein, 469 aa, Artificial Sequence
  neuraminidase__InfluenzaA__BAF47985
MNPNQKIITIGSVSLTISTICFFMQIAILITTVTLHFKQYEFNFPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26098 - protein, 469 aa, Artificial Sequence
  neuraminidase__InfluenzaA__BAF47986
MNPNQKIITIGSVSLTISTICFFMQIAILITTVTLHFKQYEFNFPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRRFYVELIRGRKEETEVLWTSNSIVVFCGTSGTYGTGSWPDGADINLMPI

SEQ ID NO: 26099 - protein, 469 aa, Artificial Sequence
  neuraminidase__InfluenzaA__BAF47987
MNPNQKIITIGSVSLTISTICFFMQIAILITTVTLHFKQYEFNFPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDKVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26100 - protein, 469 aa, Artificial Sequence; identical to SEQ ID NO: 14714
  neuraminidase__InfluenzaA__BAF47988

SEQ ID NO: 26101 - protein, 469 aa, Artificial Sequence; identical to SEQ ID NO: 14714
  neuraminidase__InfluenzaA__BAF47989

SEQ ID NO: 26102 - protein, 469 aa, Artificial Sequence
  neuraminidase__InfluenzaA__BAF47990
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVIMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTVSEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26103 - protein, 469 aa, Artificial Sequence
  neuraminidase__InfluenzaA__BAF47991
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDIVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGIRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26104 - protein, 469 aa, Artificial Sequence
  neuraminidase__InfluenzaA__BAF47992
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCEPDKCYPFALVQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSGHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSFVVFCGTSGTYGTGSWPDGADINLMPI

SEQ ID NO: 26105 - protein, 469 aa, Artificial Sequence; identical to SEQ ID NO: 26061
  neuraminidase__InfluenzaA__BAF47993

SEQ ID NO: 26106 - protein, 469 aa, Artificial Sequence; identical to SEQ ID NO: 14712
  neuraminidase__InfluenzaA__BAF47994

SEQ ID NO: 26107 - protein, 469 aa, Artificial Sequence
  neuraminidase__InfluenzaA__BAF47995
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHGRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26108 - protein, 469 aa, Artificial Sequence; identical to SEQ ID NO: 26107
  neuraminidase__InfluenzaA__BAF47996

SEQ ID NO: 26109 - protein, 469 aa, Artificial Sequence; identical to SEQ ID NO: 14714
  neuraminidase__InfluenzaA__BAF47997

SEQ ID NO: 26110 - protein, 469 aa, Artificial Sequence
  neuraminidase__InfluenzaA__BAF57504
MNPNQKIITIGSVSLTISTICFFMQIAILITTVTLHFKQYEFNPPPNNQVMLCEPTIIERNITEIVYLTNTTIEKEICPKLAEYRNWSKPQCNITGFAPFSKDNSIRLSAGGDIWVTREPYVSSDPDKCYQFALGQGTTLNNVHSNDTVHDRTPYRTLLMKELGVPFHLGTKQVCIAWSSSSCHDGKAWLHVCVTGDDENATASFIYNGRLVDSVVSWSKKILRTQESECVCINGTCTVVMTDGSASGKADTKILFIEEGKIVHTSSLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKQETEVLWTSNSIVVFCGTSGTYGTGSWPDGADINLMPI

SEQ ID NO: 26111 - protein, 469 aa, Artificial Sequence
  neuraminidase__InfluenzaA__BAF57508
MNPNQKIITIGSVSLTISTICFFMQIAILITTLTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKQETEVLWTSNSIVVFCGTSGTYGTGSWPDGADINLMPI

SEQ ID NO: 26112 - protein, 469 aa, Artificial Sequence; identical to SEQ ID NO: 15929
  neuraminidase__InfluenzaA__BAF57511

SEQ ID NO: 26113 - protein, 469 aa, Artificial Sequence
  neuraminidase__InfluenzaA__BAF57515
MNPNQRIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDKVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYLCSGLVGDTPRKNDSSSSSHCLDPNNEEGGHGVKGWAFDDGNDVWMGRTISEKLRSGYETFKVIEGWSHPNSQLQINRQVIVDRGNRSGYSGIFSVEGKSCINRCFYVELIRGRKQETEVLWTSNSIVVFCGTSGTYGTGSWPDGADINLMPI

SEQ ID NO: 26114 - protein, 469 aa, Artificial Sequence
  neuraminidase__InfluenzaA__BAF57522
MNPNQKIITIGSVSLTISTICFFMQIAILITTVTLHFKQYEFNSPPNNQVMLCEPTIIERNITEIVYLTNTIIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDRSRSSHCLDPNNEEGGHGVKGWAFDDGNDVWMGRTISEKLRSGYETFKVIEGWSKPNSKLQINRQVIVDRGNRTGYSGIFSVEGKSCINRCFYVELIRGRKQETEVLWTSNSIVVFCGTSGTYGTGSWPDGADINLMPI

SEQ ID NO: 26115 - protein, 469 aa, Artificial Sequence
  neuraminidase__InfluenzaA__BAF57529
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDKVHERTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26116 - protein, 469 aa, Artificial Sequence; identical to SEQ ID NO: 21551
  neuraminidase__InfluenzaA__BAF57532

SEQ ID NO: 26117 - protein, 469 aa, Artificial Sequence; identical to SEQ ID NO: 21551
  neuraminidase__InfluenzaA__BAF57536

SEQ ID NO: 26118 - protein, 469 aa, Artificial Sequence
  neuraminidase__InfluenzaA__BAF57539
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLIDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEKTEVLWTSNSIVVFCGTSGTYGTGSWPDGADINLMPI

SEQ ID NO: 26119 - protein, 469 aa, Artificial Sequence
  neuraminidase__InfluenzaA__BAF57543
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSAIFSVEGKSCINRCFYVELIRGRKEETEVLWTSNSIVVFCGTSGTYGTGSWPDGADINLMPI

SEQ ID NO: 26120 - protein, 469 aa, Artificial Sequence
  neuraminidase__InfluenzaA__BAF57547
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEALWTSNSIVVFCGTSGTYGTGSWPDGADINLMPI

SEQ ID NO: 26121 - protein, 469 aa, Artificial Sequence; identical to SEQ ID NO: 14714
  neuraminidase__InfluenzaA__BAF57551

SEQ ID NO: 26122 - protein, 469 aa, Artificial Sequence; identical to SEQ ID NO: 14714
  neuraminidase__InfluenzaA__BAF57555

SEQ ID NO: 26123 - protein, 469 aa, Artificial Sequence; identical to SEQ ID NO: 14712
  neuraminidase__InfluenzaA__BAF57559

SEQ ID NO: 26124 - protein, 469 aa, Artificial Sequence
  neuraminidase__InfluenzaA__BAF57563
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDIVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26125 - protein, 469 aa, Artificial Sequence; identical to SEQ ID NO: 14712
  neuraminidase__InfluenzaA__BAF57571

SEQ ID NO: 26126 - protein, 469 aa, Artificial Sequence; identical to SEQ ID NO: 21456
  neuraminidase__InfluenzaA__BAF57575

SEQ ID NO: 26127 - protein, 469 aa, Artificial Sequence; identical to SEQ ID NO: 14327
  neuraminidase__InfluenzaA__BAF57579

SEQ ID NO: 26128 - protein, 469 aa, Artificial Sequence
  neuraminidase__InfluenzaA__BAF57583
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIRVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26129 - protein, 469 aa, Artificial Sequence
  neuraminidase__InfluenzaA__BAF57587
MNPNQKIITIGSVSLTISTICFFMQIAILITTVTLHFKQCEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26130 - protein, 469 aa, Artificial Sequence
  neuraminidase__InfluenzaA__BAF57591
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVHINIKDYSIVSSYVCSGLVGDTPRKNDSSSSSHCLNPNNEEGGHGVKGWAFDDGNDVWMGRTISEKLRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26131 - protein, 469 aa, Artificial Sequence
  neuraminidase__InfluenzaA__BAF57595
MNPNQKIITIGSVSLTISTICFFMQIAILITTVTLHFKQYEFNSPPNNQVMLCEPTIIERNITEIVYLTNTTIEKEICPKIAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCVNGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 26132 - protein, 469 aa, Artificial Sequence; identical to SEQ ID NO: 21456
  neuraminidase__InfluenzaA__BAF57599

SEQ ID NO: 26133 - protein, 469 aa, Artificial Sequence
  neuraminidase__InfluenzaA__BAF57603
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPDSKLQINRQVIVDRGNRSGYSGIFSVEGKSCINRCFYVELIRGRKEETEVLGTSNSIVVFCGTSGTYGTGSWPDGADINLMPI

SEQ ID NO: 26134 - protein, 469 aa, Artificial Sequence; identical to SEQ ID NO: 21551
  Neuraminidase__InfluenzaA__BAF62620

SEQ ID NO: 26135 - protein, 470 aa, Artificial Sequence
  neuraminidase__InfluenzaA__BAF63036
MNPNQKIITIGSISIAIGIISLMLQIGNIISIWASHSIQTGSQNHTGICNQRIITYENSTWVNHTYVTINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 26136 - protein, 470 aa, Artificial Sequence; identical to SEQ ID NO: 21441
  neuraminidase__InfluenzaA__BAF63040

SEQ ID NO: 26137 - protein, 470 aa, Artificial Sequence
  neuraminidase__InfluenzaA__BAF63047
MNPNQKIITIGSISIAIGIISLVLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVNSDTADWSWPDGAELPFTIDK

SEQ ID NO: 26138 - protein, 470 aa, Artificial Sequence
  neuraminidase__InfluenzaA__BAF63058
MNPNQKIITIGSISIAIGIISLMLQIGNIISIWASHSIQTGSQNHTGICNQRIITYENSTWVNHTYVNINNTNVVAGKDKTSVTLAGNSSLCAISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNEAASYKIFKIEKGKVTKSIELNAPNFHYEECSCYPDTGTVMCVCRDNWHGSNRPWVSFNPNLDYQIGYICSGVFGDNPRPKDGEGSCNPVTVDGADGVKGFSYKYGNGVWIGRTKSNRLRKGFEMVWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 26139 - protein, 470 aa, Artificial Sequence; identical to SEQ ID NO: 21441
  neuraminidase__InfluenzaA__BAF63065

SEQ ID NO: 26140 - protein, 470 aa, Artificial Sequence; identical to SEQ ID NO: 21441
  neuraminidase__InfluenzaA__BAF63069

SEQ ID NO: 26141 - protein, 470 aa, Artificial Sequence; identical to SEQ ID NO: 21441
  neuraminidase__InfluenzaA__BAF63079

SEQ ID NO: 26142 - protein, 470 aa, Artificial Sequence; identical to SEQ ID NO: 21441
  neuraminidase__InfluenzaA__BAF63092

SEQ ID NO: 26143 - protein, 470 aa, Artificial Sequence; identical to SEQ ID NO: 21441
  neuraminidase__InfluenzaA__BAF63098

SEQ ID NO: 26144 - protein, 470 aa, Artificial Sequence
  neuraminidase__InfluenzaA__BAF63104
MNPNQKIITIGSISIAIGIISLMLQVGIVVSIWASHSIQTGSQNHTGICNQRIITYENSTWVNHTYVNINNTNVVAGKDKTSVALAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGQVTKSVELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 26145 - protein, 470 aa, Artificial Sequence
  neuraminidase__InfluenzaA__BAF63112
MNPNQKIITIGSISIAIGIISLMLQVGNIISIWASHSIQTGSQNHTGICNQRIITYENSTWVNHTYVNINNTNVVAGKDKTSVALAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGQVTKSVELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 26146 - protein, 470 aa, Artificial Sequence
  neuraminidase__InfluenzaA__BAF63116
MNPNQKIITIGSISIAIGIISLMLQVGNIISIWASHSIQTGSQNHTGICNQRIITYENSTWVNHTYVNINNTNVVAGKDKTSVALAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGLGWLTIGISGPDNGAVAVLKYNGIITETIKSWKKRILRTQESECVCVNGSCFTIMTDGPSNGAASYKIFKIEKGQVTKSVELNAPNFHYEECSCYPDTGTVMCVCRDNWHGSNRPWVSFNPDLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 26147 - protein, 470 aa, Artificial Sequence
  neuraminidase__InfluenzaA__BAF63124
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSRELNAPNFHYEECSCYPDTGTVMCVCRDNWHGSNRPWVSFNPNLDYQIGYICSGVVGDNPRPKDGKGSCNPVTADGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 26148 - protein, 470 aa, Artificial Sequence; identical to SEQ ID NO: 21503
  neuraminidase__InfluenzaA__BAF63132

SEQ ID NO: 26149 - protein, 470 aa, Artificial Sequence
  neuraminidase__InfluenzaA__BAF63136
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECKTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 26150 - protein, 449 aa, Artificial Sequence
  neuraminidase__InfluenzaA__BAH24021
MNPNQKIITIGSICMVIGIVSLMLQIGNMVSLWVSHSIQTGNQHQVEPISNTNFLTEKAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGMITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNGGTGSCGPVSPNGAYGVKGFSFKYGNGVWIGRTKSPSSRSGFEMIWDPNGWTETDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 26151 - protein, 469 aa, Artificial Sequence; identical to SEQ ID NO: 16893
  neuraminidase__InfluenzaA__BAH95825

SEQ ID NO: 26152 - protein, 469 aa, Artificial Sequence; identical to SEQ ID NO: 16728
  neuraminidase__InfluenzaA__BAH95826

SEQ ID NO: 26153 - protein, 469 aa, Artificial Sequence
  neuraminidase__InfluenzaA__BAJ07994
MNPNQKITTIGSICMVIGIVSLMLQIGNIISIWVSHSIQTGNQHQAEPCNQSIITYENNTWVNQTYVNISNTNFLTEKAVASVTLAGNSSLCPISGWAVYSKDNGIRIGSKGDVFVIREPFISCSHLECRIFFLTQGALLNDKHSNGTVKDRSPHRTLMSCPVGEAPSPYNSRFESVAWSASACHDGTSWLTIGISGPDNGAVAVLKYNGIITDTIKSWRNNIMRTQESECACVNGSCFTVMTDGPSNGQASYKIFRIEKGKVVKSAELNAPNYHYEECSCYPDAGEITCVCRDNWHGSNRPWVSFNQNLEYRIGYICSGVFGDNPRPNDGTGSCGPVSPKGAYGIKGFSFKYGNGVWIGRTKSTNSRSGFEMIWDPNGWTGTDSNFSVKQDIVAITDWSGYSGSFVQHPELTGLDCIRPCFWVELIRGRPKESTIWTSGSSISFCGVNSDTVGWSWPDGAELPFTIDK

SEQ ID NO: 26154 - protein, 449 aa, Artificial Sequence
  neuraminidase__InfluenzaA__BAK23415
MNPNQKIITIGSVCMIIGIVSLMLQIGNMISIWVGHSIQTGNQCHAEPISNTKFPTEKAAASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACINGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 26155 - protein, 449 aa, Artificial Sequence
  neuraminidase__InfluenzaA__BAK23416
MNPNQKIITIGSICMVIGIVSLMLQIGNMISIWVSHSIQTGNQCQAEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPASPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 26156 - protein, 449 aa, Artificial Sequence
  neuraminidase__InfluenzaA__BAK23417
MNPNQKIITIGSICMVIGIVSLMLQIGNMISIWVSHSIQTGNQCQSEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGISWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNGDTVSWSWPDGAELPFTIDK

SEQ ID NO: 26157 - protein, 449 aa, Artificial Sequence
  neuraminidase__InfluenzaA__BAK23418
MNPNQTIITIGSICMVIGIVSLMLQIGNMISIWVSHSIQTGNQCQAEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 26158 - protein, 449 aa, Artificial Sequence; identical to SEQ ID NO: 16577
  neuraminidase__InfluenzaA__BAK23420

SEQ ID NO: 26159 - protein, 449 aa, Artificial Sequence; identical to SEQ ID NO: 16577
  neuraminidase__InfluenzaA__BAK23421

SEQ ID NO: 26160 - protein, 449 aa, Artificial Sequence
  neuraminidase__InfluenzaA__BAK23422
MNPNQKIITIGSVCMVIGIVSLMLQIGNMISIWVGHSIQTGNQCHAEPISNTKFPTEKAAASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 26161 - protein, 449 aa, Artificial Sequence
  neuraminidase__InfluenzaA__BAK23423
MNPNQKIITIGSICMVIGIVSLMLQIGNMISIWVSHSIQTGNQCQAEPISTTKFLTEKAVASVTLAGNSSLCPISGWAVYSKDNSIRIGPRGDVFVIREPFISCSHLECRTFFLTQGALLNDKHSNGTVKDRSPHRTLMSCPVGEAPSPYNSRFESVAWSASACHDGISWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 26162 - protein, 449 aa, Artificial Sequence
  neuraminidase__InfluenzaA__BAK23424
MNPNQKIITIGSICMVIGIVSLMLQIGNMISIWVSHSIQTGNQCQGEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVFSNGAYGVKGFSFKYGNGVWIGRTKSTNSRSGFEMIWDPNGWTGTDSSFSGKQDIVAITDWSGYSGSFVQHPELTGLDCIRPCFWVELIRGRPKESTIWTSGSSISFCGVNSDTVSWSWPDGAELPFTIDK

SEQ ID NO: 26163 - protein, 449 aa, Artificial Sequence
  neuraminidase__InfluenzaA__BAK23425
MNPNQKIITIGSICMVIGIVSLMLQIGNMISIWVSHSIQTGNQCQAEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGISWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWIGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 26164 - protein, 449 aa, Artificial Sequence
  neuraminidase__InfluenzaA__BAK23426
MNPNQKIITIGSICMVIGIVSLMLQIGNMISIWVSHSIQTGNQCQAEPISNTKFFTEKAVASVTLAGNSSLCPISGWAVYSKDNSIRIGSRGDVFIIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 26165 - protein, 449 aa, Artificial Sequence; identical to SEQ ID NO: 26163
  neuraminidase__InfluenzaA__BAK23427

SEQ ID NO: 26166 - protein, 449 aa, Artificial Sequence
  neuraminidase__InfluenzaA__BAK23428
MNPNQKIITIGSICMVIGIVSLMLQIGNMISIWVSHSIQTGNQCQAEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSVSVKQDIVAITDWSGYSGSFVQHPELTGLDCIRPCFRVELIRGRPKESTIWTSGSSISFCGVNSDTVSWSWPDGAELPFTIDK

SEQ ID NO: 26167 - protein, 449 aa, Artificial Sequence; identical to SEQ ID NO: 26163
  neuraminidase__InfluenzaA__BAK23429

SEQ ID NO: 26168 - protein, 449 aa, Artificial Sequence
  neuraminidase__InfluenzaA__BAK23430
MNPNQKIITIGSICMVIGIVSLMLQIGNMISIWVSHSIQTGNQCQAEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGISWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWIGTDSSFSVKQDIVAITDWSGYSGSFVQHPELTGLDCMRPCFWVELIRGRPKESTIWTSGSSISFCGVNSDTVSWSWPDGAELPFTIDK

SEQ ID NO: 26169 - protein, 449 aa, Artificial Sequence
  neuraminidase__InfluenzaA__BAK23431
MNPNQKIITIGSICMVIGIVSLMLQIGNMISIWVSHSIQTGNQCQAEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWGPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 26170 - protein, 449 aa, Artificial Sequence; identical to SEQ ID NO: 26163
  neuraminidase__InfluenzaA__BAK23432

SEQ ID NO: 26171 - protein, 449 aa, Artificial Sequence; identical to SEQ ID NO: 26163
  neuraminidase__InfluenzaA__BAK23433

SEQ ID NO: 26172 - protein, 469 aa, Artificial Sequence
  neuraminidase__InfluenzaA__BAM65748
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCFQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKTDSSSSSHCLDPNNEEGGHGVKGWAFDDGNDVWMGRTISEKSRLGYETFKVIGGWSNPNSKSQINRQVIVDMGNRSGYSGIFSVEGKSCINRCFYVELIRGRKDETEVLWTSNSIVVFCGTSGTYGTGSWPDGADIKLMSI

SEQ ID NO: 26173 - protein, 449 aa, Artificial Sequence
  neuraminidase__InfluenzaA__BAM85817
MNPNQKIITIGSICMVTGIVSLMLQIGNMISIWVSHSIHTGNQHQSEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPNAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 26174 - protein, 449 aa, Artificial Sequence
  neuraminidase__InfluenzaA__BAM85818
MNPNQKIITIGSICMVIGIVSLMLQIGNMISIWVSHSIQTGNQHQAEPIRNTNFLTENAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELNAPNYHYEECSCYPDAGEIICVCRDNWHGSNRPWVSFNQNLEYQIGYICSGVFGDNPRPNDGTGSCGPVSPNGAYGIKGFSFKYGNGVWIGRTKSTNSRSGFEMIWDPNGWTGTDSNFSVKQDIVAITDWSGYSGSFVQHPELTGLDCIRPCFWVELIRGRPKESTIWTSGSSISFCGVNSDTVSWSWPDGAELPFTIDK

SEQ ID NO: 26175 - protein, 449 aa, Artificial Sequence
  neuraminidase__InfluenzaA__BAM85819
MNPNQKIITIGSICMVIGIVSLMLQIGNMISIWVSHSIQTGNQNQVEPIINTNFLTEKAVASITLAGNSSLCPIRGWAIHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSDGQASYKIFKMEKGKVIKSVELDAPNYHYEECSCYPDAGEITCVCRDNWHGSNRPWVSFNQNLEYQIGYICSGVFGDNPRPNDGTGSCGPVSHNGAYGVKGFSFKYGNGVWIGRTKSPNSRSGFEMIWDPNGWSETDSSFSVKQDIVAITDWSGYSGSFVQHPELTGLDCIRPCFWVELIRGRPKESTVWTSGSSISFCGVSSDTVSWSWPDGAELPFTIDK

SEQ ID NO: 26176 - protein, 449 aa, Artificial Sequence
  neuraminidase__InfluenzaA__BAM85820
MNPNQKIITIGSICMVIGIVSLMLQIGNMISIWVSHSIQTGNQHQAEPISNTNFLTEKAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 26177 - protein, 449 aa, Artificial Sequence; identical to SEQ ID NO: 15008
  neuraminidase__InfluenzaA__BAM85821

SEQ ID NO: 26178 - protein, 449 aa, Artificial Sequence
  neuraminidase__InfluenzaA__BAM85822
MNPNQKIITIGSICMVTGIVSLMLQIGNMISIWVSHSIHTGNQHQSEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVVKYNGIITDTIKSWRNNILRTQESECACVNGSCFTVMTDGPSNSQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 26179 - protein, 469 aa, Artificial Sequence
  neuraminidase__InfluenzaA__BAM85823
MNPNQKITTIGSICMVIGIVSLMLQIGNIISIWVSHSIQTGNQHQAGPCNQSIITYENNTWVNQTYVNISNTNFLTEKTVASVTLAGNSSLCPISGWAVYSKDNGIRIGSKGDVFVIREPFISCSHLECRTFFLTQGALLNDKHSNGTVKDRSPHRTLMSCPVGEAPSPYNSRFESVAWSASACHDGINWLTIGISGPDNGAVAVLKYNGIITDTIKSWRNNILRTQESECACVNGSCFTIMTDGPSNGQASYKIFRIEKGKVVKSVELNAPNYHYEECSCYPDAGEITCVCRDNWHGSNRPWVSFNQNLEYQIGYICSGIFGDNPRPNDGTGSCGPVSPNGAYGIKGFSFKYGNGVWIGRTKSTNSRSGFEMIWDPNGWTGTDSNFSVKQDIVAITDWSGYSGSFVQHPELTGLDCIRPCFWVELIRGRPKESTIWTSGSSISFCGVNSDTVGWSWPDGAELPFTIDK

SEQ ID NO: 26180 - protein, 449 aa, Artificial Sequence
  neuraminidase__InfluenzaA__BAM85824
MNPNQKIITIGSICMVIGIVSLLLQIGNMISIWISHSIQTGNQHQAESISNTNPLTEKAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELDAPNYHYEECSCYPDASEITCVCRDNWHGSNRPWVSFNQNLEYQIGYICSGVFGDNPRPNDGTGSCGPMFPNGAYGIKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 26181 - protein, 449 aa, Artificial Sequence
  neuraminidase__InfluenzaA__BAM85825
MNPNQKIITIGSICMVIGIVSLMLQIGNMISIWVSHSIQTGNQNQVEPIINTNFLTEKAVASITLAGNSSLCPIRGWAIHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVIKSVELDAPNYHYEECSCYPDAGEITCVCRDNWHGSNRPWVSFNQNLEYQIGYICSGVFGDNPRPNDGTGSCGPVSHNGAYGVKGFSFKYGNGVWIGRTKSPNSRSGFEMIWDPNGWSETDSSFSVKQDIVAITDWSGYSGSFVQHPELTGLDCIRPCFWVELIRGRPKESTVWTSGSSISFCGVNSDTVSWSWPDGAELPFTIDK

SEQ ID NO: 26182 - protein, 449 aa, Artificial Sequence
  neuraminidase__InfluenzaA__BAM85826
MNPNQKIITIGSICMVIGIVSLMLQIGNMISIWVSHSIQTGNQRQAEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPVSLNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 26183 - protein, 449 aa, Artificial Sequence
  neuraminidase__InfluenzaA__BAM85827
MNPNQKIITIGSICMVIGVVSLMLQTGNIISIWVSHSIQKGNQHQAESISNTNPLTEKAVASVTLAGNSSLCPIRGWAVHSKDNNIRIGSKGDVFVIREPFISCSHLECRTFFLTQGALLNDKHSNGTVKDRSPHRTLMSCPVGEAPSPYNSRFESVAWSASACHDGTSWLTIGISGPDNEAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSPNGAYGVKGFSFKYGNGVWIGRTKSTTSRSGFEMIWDPNGWTGTDSSFSVKQDIVAITDWSGYSGSFVQHPELTGLDCIRPCFWVELIRGRPKESTIWTSGSSISFCGVDSDTVSWSWPDGAELPFTIDK

SEQ ID NO: 26184 - protein, 449 aa, Artificial Sequence
  neuraminidase__InfluenzaA__BAM85828
MNPNQKIITIGSICMVIGIVSLMLQIGNMISIWVSHSIQTGNQRQAEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 26185 - protein, 449 aa, Artificial Sequence
  neuraminidase__InfluenzaA__BAM85829
MNPNQKIITIGSICMIIGIVSLMLQIGNIISIWVSHSIQTGNQHQAEPISDTNFLTEKAVASVILAGNSSLCHISGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNYILRTQESECACVNGSCFTVMTDGPSNGQASYKIFKIEKGKVVKSVELDAPNYHYEECSCYPDAGEITCVCRDNWHGSNRPWVSFNQNLEYQIGYICSGVFGDTPRPNDGTGSCGPVSPNGAYGVKGFSFKYGNGVWIGRTKSTNSRSGFEMIWDPNGWTGTDSSFSVKQDLVAITDWSGYSGSFVQHPELTGLDCIRPCFWVELIRGRPKESTIWTSGSSISFCGVNSDTVGWSWPDGAELPFTIDK

SEQ ID NO: 26186 - protein, 470 aa, Artificial Sequence
  neuraminidase__InfluenzaA__BAM85830
MNPNQKIITIGSICMAIGTISLILQIGNIISIWISHSIQTGSQNHTGICNQRIITYENNTWVNQTYVNISNTNVVAGKDTTSMILAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITEIIKSWRKQILRTQESECVCVNGSCFTIMTDGPSNGPASYRIFKIKKGKITKSIELDAPNSHYEECSCYPDTGKVMCVCRDNWHGSNRPWVSFNQNLDYQIGYICSGVFGDNPRPKDGKGSCDPVNVDGADGVKGFSYRYGNGVWIGRTKSNSSRKGFEMIWDPNGWTDTDGNFLVKQDVVAMTDWSGYSGSFVQHPELTGLDCMRPCFWVELIRGQPREKTTIWTSGSSISFCGVNSDTVNWSWPDGAELPFTIDK

SEQ ID NO: 26187 - protein, 470 aa, Artificial Sequence
  neuraminidase__InfluenzaA__BAM85831
MNPNQKIITIGSISIAIGIISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGIGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPRDGEGSCNPVTADGANGVKGFSYKYGNGVWIGRTKSNRLRKGFEMIWDPNGWTDTDSDFSVKQDVVAITDWSGYSGSFVQHPELTGLGCIRPCFWVELVRGLPRENTTIWTSGSSISFCGVNSDTANWSWPDGAELPFTIDK

SEQ ID NO: 26188 - protein, 470 aa, Artificial Sequence; identical to SEQ ID NO: 21508
  neuraminidase__InfluenzaA__BAM85832

SEQ ID NO: 26189 - protein, 469 aa, Artificial Sequence
  neuraminidase__InfluenzaA__BAM85833
MNPNQKIITIGSTCMVIGIISLILQIGNIISIWVSHSIQTGNQNQPETCNQSVITYENKTWVNQTYVNISNTNLVIERDVISVALLGNSSLCPISGWAIYSKDNGIRIGSKGDVFVIREPFISCSHLECRTFFLTQGALLNDKHSNGTVKDRSPYRTLMSCPVGEAPSPYNSRFESVAWSASACHDGISWLTVGISGPDNGAVAVLKYNGIITDTVKSWRNNILRTQESECACINGSCFTIMTDGPSNGQASYKIFKIEKGKVVKSVELNAPNYHYEECSCYPDASEIMCVCRDNWHGSNRPWVSFNRNLEYQIGYICSGVFGDNPRPNDGTGSCGPVSSNGAYGVKGFSFKYGKGVWIGRTKSTSSRSGFEMIWDPNGWTETDSSFSVKQDIVAITDWSGYSGSFVQHPELTGLDCIRPCFWVELIRGRPKENTIWTSGSSISFCGVNSDTVGWSWPDGAELPFTIDK

SEQ ID NO: 26190 - protein, 469 aa, Artificial Sequence
  neuraminidase__InfluenzaA__BAM85834
MNPNQKIITIGSVSLTVATVCFLMQIAILTTTVTLHFKQNECSIPANNQVMPCEPIVIERNITEIVYLNNTTIEKEICLKAAEYRNWSKPQCQITGFAPFSKDNSIRLSAGGDIWVTREPYVSCDPSKCYQFALGQGTTLENKHSNGTIHDRIPHRTLLMNELGVPFHLGTKQVCIAWSSSSCHDGKAWLHVCVTGDDRNATASFIYDGMLVDSIGSWSQNILRTQESECVCINGTCAVVMTDGSASGRADTRILFIREGKIVHISPLSGSAQHIEECSCYPRYPIIRCVCRDNWKGSNRPVIDINMADYSIDSSYVCSGLVGDTPRNDDSSSSSNCRDPNNERGNPGVKGWAFDNGNDVWMGRTISKDSRSGYETFRVIGGWATANSKSQTNRQVIVDNNNWSGYSGIFSVESKSCINRCFYVELIRGRPQETRVWWTSNSIVVFCGTSGTYGTGSWPDGANINFMPI

SEQ ID NO: 26191 - protein, 469 aa, Artificial Sequence
  neuraminidase__InfluenzaA__BAM85835
MNPNQKIITIGSVSLTIATVCFLMQIAILATTVTLHFKQNECSIPANNQVVPCEPIIIERNITEIVYLNNTTIEKEICSKAVDYRNWSKPQCQITGFAPFSKDNSIRLSAGGDIWVTREPYVSCDTSKCYQFALGQGTTLDNKHSNGTIHDRIPHRTLLMNELGVPFHLGTKQVCIAWSSSSCHDGKAWLHVCVTGDDRNATASFIYNGMLVDSIGSWSQNILRTQESECVCINGSCTVVMTDGSASGKADTRILFVKEGKIIHISPLSGSAQHIEECSCYPRYPNVRCVCRDNWRGSNRPVIDINMADYSIDSSYVCSGLVGDTPRNDDNSSSSNCRDPNNERGNPGVKGWAFDSGDDVWMGRTISRDSRSGYETFKVIGGWATANSKSQTSRQVIVDNNNWSGYSGVFSVEHKSCINRCFYVELIRGRPQETRVWWTSNSIVVFCGTSGTYGTGSWPDGANINFMPI

SEQ ID NO: 26192 - protein, 469 aa, Artificial Sequence
  neuraminidase__InfluenzaA__BAM85836
MNPNQKIITIGSVSLTIATICFLMQIAILATTVTLHFKQNGCSIPSNNQVVPCEPIIVERNITEIVYLNNTTIEKELCPKVLEYRDWSKPQCQITGFAPFSKDNSIRLSAGGDIWVTREPYVSCSPDKCYQFALGQGTTLDNRHSNGTIHDRIPHRTLLMNELGVPFHLGTKQVCIAWSSSSCHDGRAWLHVCVTGDDRNATASFIYDGMLVDSIGSWSQNILRTQESECVCINGTCTVVMTDGSASGRADTRILFVKEGKIVHISPLSGSAQHIEECSCYPRYPDVRCVCRDNWKGSNRPIIDINMADYSIGSSYVCSGLVGDTPRNDDSSSNSNCRDPNNERGNPGVKGWAFDYGNDVWMGRTISKDSRSGYETFRVIGGWTTANSKSQVNRQVIVDNSNWSGYSGIFSVEGKSCINRCFYVELIRGRPQETRVWWTSNSIVVFCGTSGTYGTGSWPDGANINFMPI

SEQ ID NO: 26193 - protein, 469 aa, Artificial Sequence
  neuraminidase__InfluenzaA__BAO79717
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKNCINRCFYVELIRGRKEETEVLWTSNSIVVFCGTSGTYGTGSWPDGADLNLMPI

SEQ ID NO: 26194 - protein, 470 aa, Artificial Sequence; identical to SEQ ID NO: 15059
  neuraminidase__InfluenzaA__CAA33354

SEQ ID NO: 26195 - protein, 467 aa, Artificial Sequence
  Neuraminidase__InfluenzaA__CAB95858
MNPNQKIIALGSVSITIATICLLMQIAILATTMTLHFNECTNPSNNQAMPCEPIIIERNITEIVHLNNTTIEKESCPKVAEYKNWSKPQCQITGFAPFSKDNSIRLSAGGDIWVTREPYVSCGLGNCYQFALGQGTTLNNKHSNGTIHDRSPHRTLLMNELGVPFHLGTKQVCIAWSSSSCHDGKAWLHVCVTGDDRNATASIIYDGMLTDSIGSWSKNILRTQESECVCINGTCTVVMTDGSASGRADTKILFIREGKIVHISPLSGSAQHVEECSCYPRYPEVRCVCRDNWKGSNRPVLYINVADYSVDSSYVCSGLVGDTPRNDDSSSSSNCRDPNNERGGPGVKGWAFDNGNDVWMGRTIKKDSRSGYETFRVVGGWTTANSKSQINRQVIVDSDNWSGYSGIFSVEGKTCINRCFYVELIRGRPQETRVWWTSNSIIVFCGTSGTYGTGSWPDGANINFMSI

SEQ ID NO: 26196 - protein, 467 aa, Artificial Sequence
  neuraminidase__InfluenzaA__CAB95859
MNPNQKIIALGSVSITIATICLLMQIAILATTMTLHFNECTNPSNNQAVPCEPIIIERNITEIVHLNNTTIEKESCPKVAEYKNWSKPQCQITGFAPFSKDNSIRLSAGGDIWVTREPYVSCGLGKCYQFALGQGTTLNNKHSNGTIHDRSPHRTLLMNELGVPFHLGTKQVCIAWSSSSCHDGKAWLHVCVTGDDRNATASIIYDGMLTDSIGSWSKNILRTQESECVCINGTCTVVMTDGSASGRADTKILFIREGKIVHIGPLSGSAQHVEECSCYPRYPEVRCVCRDNWKGSNRPVLYINVADYSVDSSYVCSGLVGDTPRNDDSSSSSNCRDPNNERGGPGVKGWAFDNGNDVWMGRTIKKDSRSGYETFRVVGGWTTANSKSQINRQVIVDSDNWSGYSGIFSVEGKTCINRCFYVELIRGRPQETRVWWTSNSIIVFCGTSGTYGTGSWPDGANINFMSI

SEQ ID NO: 26197 - protein, 469 aa, Artificial Sequence; identical to SEQ ID NO: 14573
  Neuraminidase__InfluenzaA__CAC19707

SEQ ID NO: 26198 - protein, 469 aa, Artificial Sequence
  neuraminidase__InfluenzaA__CAD29959
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 26199 - protein, 469 aa, Artificial Sequence
  neuraminidase__InfluenzaA__CAD29960
MNPNQKIITIGSVSLTIATICFLMQIAILVTTVTLHFKQYECNPPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHVRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 26200 - protein, 469 aa, Artificial Sequence
  neuraminidase__InfluenzaA__CAD29961
MNPNQKIITIGSVSLTISTICFFMQIAILVTTVTLHFKQYECNSPPNNQVMLCEPTIIERNTTEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSGPDGADINLMPI

SEQ ID NO: 26201 - protein, 469 aa, Artificial Sequence; identical to SEQ ID NO: 21545
  neuraminidase__InfluenzaA__CAD29962

SEQ ID NO: 26202 - protein, 469 aa, Artificial Sequence; identical to SEQ ID NO: 14284
  neuraminidase__InfluenzaA__CAD29963

SEQ ID NO: 26203 - protein, 469 aa, Artificial Sequence; identical to SEQ ID NO: 14284
  neuraminidase__InfluenzaA__CAD29964

SEQ ID NO: 26204 - protein, 469 aa, Artificial Sequence; identical to SEQ ID NO: 14284
  neuraminidase__InfluenzaA__CAD29965

SEQ ID NO: 26205 - protein, 469 aa, Artificial Sequence; identical to SEQ ID NO: 14284
  neuraminidase__InfluenzaA__CAD29966

SEQ ID NO: 26206 - protein, 469 aa, Artificial Sequence; identical to SEQ ID NO: 14040
  neuraminidase__InfluenzaA__CAD29967

SEQ ID NO: 26207 - protein, 469 aa, Artificial Sequence; identical to SEQ ID NO: 14040
  neuraminidase__InfluenzaA__CAD29968

SEQ ID NO: 26208 - protein, 469 aa, Artificial Sequence; identical to SEQ ID NO: 14573
  neuraminidase__InfluenzaA__CAD29969

SEQ ID NO: 26209 - protein, 469 aa, Artificial Sequence
  neuraminidase__InfluenzaA__CAD29970
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYPGIRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 26210 - protein, 469 aa, Artificial Sequence; identical to SEQ ID NO: 16555
  neuraminidase__InfluenzaA__CAD29971

SEQ ID NO: 26211 - protein, 469 aa, Artificial Sequence
  neuraminidase__InfluenzaA__CAD29972
MNPNQKIITIGSVSLTIATICFLMQIVILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDKNATASFIYNGRLVDSIGSWSKKILRTQESECVCINGTCAVVMTDGSASGKADTKILFIEEGKIGHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRNQETEILWTSNSIVVFCGTSGTYGTGSWPDGADINLMPI

SEQ ID NO: 26212 - protein, 469 aa, Artificial Sequence
  neuraminidase__InfluenzaA__CAD29973
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYSGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 26213 - protein, 469 aa, Artificial Sequence; identical to SEQ ID NO: 22584
  neuraminidase__InfluenzaA__CAD29974

SEQ ID NO: 26214 - protein, 469 aa, Artificial Sequence
  neuraminidase__InfluenzaA__CAD29984
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREHYVSCDRDKCYQFALGQGTTLNNGHSNDTVHDRTPYRTLLMNELGVPFHLGTKQVCIAWSSSSCHHGKAWLHVCVTGDDENATASFIYNGRLVDSIGSWSKKILRTQESECVCINGTCTVVMTDGSASGKADTKILFIKEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKANSKLQINRQVIVDRGNRSGYSGIFSVESKSCINRCFYVELIRGRKQETEVLWTSNSIVVFCGTSGTYGTGSWPDGADINLMPI

SEQ ID NO: 26215 - protein, 469 aa, Artificial Sequence
  neuraminidase__InfluenzaA__CAD29985
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSRTYGTGSWPDGADINLMPI

SEQ ID NO: 26216 - protein, 469 aa, Artificial Sequence
  neuraminidase__InfluenzaA__CAD29988
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASEKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 26217 - protein, 469 aa, Artificial Sequence
  neuraminidase__InfluenzaA__CAD29990
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHGRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDNSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 26218 - protein, 469 aa, Artificial Sequence; identical to SEQ ID NO: 14061
  neuraminidase__InfluenzaA__CAD29991

SEQ ID NO: 26219 - protein, 469 aa, Artificial Sequence
  neuraminidase__InfluenzaA__CAD29992
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDRSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 26220 - protein, 469 aa, Artificial Sequence
  neuraminidase__InfluenzaA__CAD29993
MNPNQKIITIGSVSLTIATTCFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSPLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 26221 - protein, 469 aa, Artificial Sequence; identical to SEQ ID NO: 15749
  neuraminidase__InfluenzaA__CAD29994

SEQ ID NO: 26222 - protein, 470 aa, Artificial Sequence; identical to SEQ ID NO: 16453
  neuraminidase__InfluenzaA__CAD57252

SEQ ID NO: 26223 - protein, 470 aa, Artificial Sequence
  neuraminidase__InfluenzaA__CAD57253
MNPNQKIITIGSIRIAIGIISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKITKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 26224 - protein, 470 aa, Artificial Sequence; identical to SEQ ID NO: 14396
  neuraminidase__InfluenzaA__CAD57255

SEQ ID NO: 26225 - protein, 470 aa, Artificial Sequence
  neuraminidase__InfluenzaA__CAD57256
MNPNQKIITIGSISVAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGRPRENTTIWTSGSSISFCGVNSDTANWSWPDGAELPFTIDK

SEQ ID NO: 26226 - protein, 470 aa, Artificial Sequence
  neuraminidase__InfluenzaA__CAD57257
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNSHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDVVAMTDWSGYSGSFVQHPELTGLDCIRPCFWVELVRGRPRENTTIWTSGSSISFCGVNSDTANWSWPDGAELPFTIDK

SEQ ID NO: 26227 - protein, 470 aa, Artificial Sequence
  neuraminidase__InfluenzaA__CAD57258
MNPNQKIITIGSISVAIGIISLILQIGNIISIWASHSIQTGSQNYTGICNQRIITYENSTWVNQTYVNINNTNVVAGKDKTSMVLAGNSSLCPIRGWAIYTKDNSIRIGSKGDIFVIREPFISCSHLECRTFFLTQGALLNDKHSNGTVKDRSPYRALMSCPLGEAPSPYNSRFESVAWSASACHDGLGWLTIGISGPDNGAVAVLKYNGIITETIKSWKKQILRTQESECVCVNGSCFTIMTDGPSNRAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDVVAMTDWSGYSGSFVQHPELTGLDCMRPCFWVELVRGLPRENTTIWTSGSSISFCGVNSETANWSWPDGAELPFTIDK

SEQ ID NO: 26228 - protein, 470 aa, Artificial Sequence
  neuraminidase__InfluenzaA__CAD57259
MNPNQKIITIGSISIAIGIISLILQIGNIISIWASHSIQTESQNHTGICNQRIITYENSTWVNQTYVNINNTNVAAGKDKTSMTLAGNSSLCPIRGWAIYTKDNSIRIGSKGDIFVIREPFISCSHLECRTFFLTQGALLNDKHSNGTVKDRSPYRALMSCPLGEAPSPYNSRFESVAWSASACHDGLGWLTIGISGPDNGAVAVLKYNGIITETIKSWKKRILRTQESECVCMNGSCFTIMTDGPSNGAASYRIFKIEKGRVTKSIELDAPNYHYEECSCYPETGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDIVAMTDWSGYSGSFVQHPELTGLDCMRPCFWVELVRGLPRENTTIWTSGSSISFCGVNSDTANWSWPDGAELPFTIDK

SEQ ID NO: 26229 - protein, 470 aa, Artificial Sequence
  neuraminidase__InfluenzaA__CAD57264
MNPNQKIITIGSISVAIGIISLILQIGNIISIWASHSIQTGSQNYTGICNQRIITYENSTWVNQTYVNINNTNVVAGKDKTSMTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGLGWLTIGISGPDNGAVAVLKYNGIITETIKSWKKQILRTQESECVCVNGSCFTIMTDGPSNGAASYRIFKIEKGRVTKSIELDAPNYHYEECSCYPDTGTVMCVCRDNWHGSNRPWVSFNQNLDYQIGYICSGVFGDNPRPKDGEGSCNPVTVDGANGVKGFSYRYGNGVWIGRTKSNRLRKGFEMIWDPNGWTDTDSDFSMKQDVVAMTDWSGYSGSFVQHPELTGLDCMRPCFWVELVRGLPRENTTIWTSGSSISFCGVNSETANWSWPDGAELPFTIDK

SEQ ID NO: 26230 - protein, 449 aa, Artificial Sequence
  neuraminidase__InfluenzaA__CBW54819
MNPNQKIITIGSICMVIGIVSLMLQIGNMISIWVSHSIQTGNQCQAEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGISWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDNWHGSNRPWVSFNQNLEYRIGYICSGVFGDNPRPNDGTGSCGPVSPNGAYGVKGFSFKYGDGVWIGRTKSTNSRSGFEMVWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 26231 - protein, 449 aa, Artificial Sequence
  neuraminidase__InfluenzaA__CBW54821
MNPNQKIITIGSICIVIGIVSLMLQIGNMISIWVSHSIQTGNQCQAEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGISWLTIGISGPDNGAVAVLKYNGIITDTIKSWRNNILRTQESECACINGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGQPKESTIWTSGSSISFCGVNSDTVSWSWPDGAELPFTIDK

SEQ ID NO: 26232 - protein, 469 aa, Artificial Sequence
  neuraminidase__InfluenzaA__CCG47912
MNPNQKIITIGSVSLTIATMCLFMQIAILITTVTLHFKQYECDSPANNQVMPCEPIIIEKNITKIVYLTNTTIEKEVCPKLGEYRNWSKPQCRITGFAPFSKDNSIRLSAGGAIWVTREPYVSCDPNKCYQFALGQGTTLDNRHSNDTIHDRTPYRTLLMNELGVPFHLGTRQVCIAWSSSSCHDGKAWLHVCVTGHDKNATASFIYDGKLVDSISSWSQNILRTQESECVCINGICTVVMTDGSASGKADTKILFIEEGKVIHISPLLGSAQHVEECSCYPRYPDVRCICRDNWKGSNRPIVDIRMKDYSIGSSYMCSGLVGDTPRNNDGSSNSNCRNPNNERGNHGVKGWAFDDGNDIWMGRTISKDSRLGYETFKVVGGWSQPNSKFQINRQVIVDSDNRSGYSGIFSVEGKSCINRCFYVELIRGRRQETRVWWTSNSIVVFCGTSGTYGSGSWPDGADINFMPI

SEQ ID NO: 26233 - protein, 450 aa, Artificial Sequence
  neuraminidase_subtype_1__InfluenzaA__AAF74321
MNPNQKIITIGSICMVVGIISLMLQIGNIISVWVSHTIQTWHPNQPEPCNQSINFYTEQAAASVTLAGNSSLCPISGWAIYSKDNSIRIGSKGDVFVIREPFISCSHLECRTFFLTQGALLNDKHSNGTVKDRSPYRTLMSCPVGEAPSPYNSRFESVAWSASACHDGISWLTIGISGPDNGAVAVLKYNGIITDTIKSWRNNILRTQESECACVNGSCFTVMTDGPSNEQASYKIFKIEKGRVVKSVELNAPNYHYQECSCYPDAGEITCVCRDNWHGSNRPWVSFNQNLEYQIGYICSGVFGDSPRPNDGTGSCGPVSLNGAYGVKGFSFKYGNGVWIGRTKSTSSRSGFEMIWDPNGWTETDSSFSLKQDIIAITDWSGYSGSFIQHPELTGLNCMRPCFWVELIRGRPKEKTIWTSGSSISFCGVNSDTVGWSWPDGAELPFTIDK

SEQ ID NO: 26234 - protein, 450 aa, Artificial Sequence
  neuraminidase_subtype_1__InfluenzaA__AAF74322
MNPNQKIITIGSICMVVGIISLMLQIGNTISVWVSHIIKTWHPNQPEPCNQSINFYTEQAAASVTLAGNSSLCPISGWAIYSKDNSIRIGSKGDVFVIREPFISCSHLECRTFFLTQGALLNDKHSNGTVKDRSPYRTLMSCPVGEAPSPYNSRFESVAWSASACHDGISWLTIGISGPDNGAVAVLKYNGIITDTIKSWRNNTLRTQESECACVNGSCFTVMTDGPSNEQASYKIFKIEKGRVVKSVELNAPNYHYEECSCYPDAGEITCVCRDNWHGSNRPWVSFNQNLEYQIGYICSGVFGDSPRPNDGTGSCGPVSLNGAYGVKGFSFKYGNGVWIGRTKSTSSRSGFEMIWDPNGWTETDSSFSLKQDIIAITDWSGYSGSFIQHPELTGLNCMRPCFWVELIRGRPKEKTIWTSGSSISFCGVNSDTVGWSWPDGAELPFTIDK

SEQ ID NO: 26235 - protein, 450 aa, Artificial Sequence
  neuraminidase_subtype_1__InfluenzaA__AAF74323
MNPNQKIITIGSICMVVGIISLMLQIGNIISVWISHIIQTWHPNQPEPCNQSINFYTEQAAASVTLAGNSSLCPISGWAIYSKDNSIRIGSKGDVFVIREPFISCSHLECRTFFLTQGALLNDKHSNGTVKDRSPYRTLMSCPVGEAPSPYNSRFESVAWSASACHDGISWLTIGISGPDNEAVAVLKYNGIITDTIRSWRNNILRTQESECACVNGSCFTVMTDGPSNEQASYKIFKIEKGRVVKSVELNAPNYHYEECSCYPDAGEITCVCRDNWHGSNRPWVSFNQNLEYQIGYICSGVFGDSPRPNDGTGSCGPVSLNGAYGVKGFSFKYGNGVWIGRTKSTSSRSGFEMIWDPNGWTETDSSFSLKQDIIAVTDWSGYSGSFIQHPELTGLNCMRPCFWVELIRGRPKEKTIWTSGSSISFCGVNSDTVGWSWPDGAELPFTIDK

SEQ ID NO: 26236 - protein, 450 aa, Artificial Sequence
  neuraminidase_subtype_1__InfluenzaA__AAF74324
MNPNQKIITIGSICMVVGIISLMLQIGNIISVWVSHIIQTWHPNQPEPCNQSINFYTEQAAASVTLAGNSSLCPISGWAIYSKDNSIRIGSKGDVFVIREPFISCSHLECRTFFLTQGALLNDKHSNGTVKDRSPYRTLMSCPVGEAPSPYNSRFESVAWSASACHDGISWLTIGISGPDNGAVAVLKYNGIITDTIKSWRNNILRTQESECACVNGSCFTVMTDGPSNEQASYKIFKIEKGRVVKSVELNAPNYHYEECSCYPDAGEITCVCRDNWHGSNRPWVSFNQNLEYQIGYICSGVFGDSPRPNDGTGSCGPVSLNGAYGVKGFSFKYGNGVWIGRTKSTSSRSGFEMIWDPNGWTETDSSFSLKQDIIAITDWSGYSGSFIQHPELTGLNCMRPCFWVELIRGRPKEKTIWTSGSSVSFCGVNSDTMGWSWPDGAELPFTIDK

SEQ ID NO: 26237 - protein, 450 aa, Artificial Sequence
  neuraminidase_subtype_1__InfluenzaA__AAF74325
MNPNQKIITIGSICMVVGIISLMLQIGNTISVWVSHIIKTWHPNQPEPCNQSINFYTEQAAASVTLAGNSSLCPISGWAIYSKDNSIRIGSKGDVFVIREPFISCSHLECRTFFLTQGALLNDKHSNGTVKDRSPYRTLMSCPVGEAPSPYNSRFESVAWSASACHDGISWLTIGISGPDNGAVAVLKYNGIITDTIKSWRNNTLRTQESECACVNGSCFTVMTDGPSNEQASYKIFKIEKGRVVKSVELNAPNYHYEECSCYPDAGEITCVCRDNWHGSNRPWVSFNQNLEYQIGYICSGVFGDSPRPNDGTGSCGPVSLNGAYGVKGFSFKYGNGVWIGRTKSTSSRSGFEMIWDPNGWTETDSSFSLKQDIIAITDWSGYSGSFIQHPELTGLNCMRPCFWVELIRGRPKEKTIWTSGSSISFCGVNSDTVGWSWPDGAELPYTIDK

SEQ ID NO: 26238 - protein, 469 aa, Artificial Sequence; identical to SEQ ID NO: 16728
  neuraminidase__InfluenzaA__EPI239900

SEQ ID NO: 26239 - protein, 469 aa, Artificial Sequence; identical to SEQ ID NO: 17077
  neuraminidase__InfluenzaA__EPI221062

SEQ ID NO: 26240 - protein, 469 aa, Artificial Sequence; identical to SEQ ID NO: 16728
  neuraminidase__InfluenzaA__EPI534079

SEQ ID NO: 26241 - protein, 469 aa, Artificial Sequence; identical to SEQ ID NO: 16728
  neuraminidase__InfluenzaA__AGM53851

SEQ ID NO: 26242 - protein, 469 aa, Artificial Sequence
  neuraminidase__InfluenzaA__EPI731464
MNPNQKIITIGSVCMTIGMANLILQIGNIISIWISHSIQLGNQNQIETCNQSVITYENNTWVNQTYVNISNTNFAAGQSVVSVKLAGGSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 26243 - protein, 469 aa, Artificial Sequence; identical to SEQ ID NO: 16728
  neuraminidase__InfluenzaA__EPI696973

SEQ ID NO: 26244 - protein, 469 aa, Artificial Sequence
  neuraminidase__InfluenzaA__EPI662593
MNPNQKIITIGSICMTIGMANLILQIGNIISIWVSHSIQIGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIIKSVEMKAPNYHYEECSCYPDSSEITCVCRDNWHGSNRPWVSFNQNLEYQMGYICSGVFGDNPRPNDKTGSCGPVSSNGANGVKGFSFKYGNGVWIGRTKSISSRKGFEMIWDPNGWTGTDNKFSIKQDIVGINEWSGYSGSFVQHPELTGLDCIRPCFWVELIRGRPEENTIWTSGSSISFCGVNSDTVGWSWPDGAELPFTIDK

SEQ ID NO: 26245 - protein, 469 aa, Artificial Sequence; identical to SEQ ID NO: 26244
  neuraminidase__InfluenzaA__EPI830229

SEQ ID NO: 26246 - protein, 469 aa, Artificial Sequence; identical to SEQ ID NO: 23837
  neuraminidase__InfluenzaA__AGU92879

SEQ ID NO: 26247 - protein, 469 aa, Artificial Sequence; identical to SEQ ID NO: 23836
  neuraminidase__InfluenzaA__AGU92857

SEQ ID NO: 26248 - protein, 469 aa, Artificial Sequence; identical to SEQ ID NO: 23835
  neuraminidase__InfluenzaA__AGU92846

SEQ ID NO: 26249 - protein, 469 aa, Artificial Sequence; identical to SEQ ID NO: 23846
  neuraminidase__InfluenzaA__AGU92835

SEQ ID NO: 26250 - protein, 469 aa, Artificial Sequence; identical to SEQ ID NO: 23822
  neuraminidase__InfluenzaA__AGU92703

SEQ ID NO: 26251 - protein, 469 aa, Artificial Sequence
  neuraminidase__InfluenzaA__EPI643117
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECICINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQTNRQVIVDRGDRSGYSGIFSVEGKSCINRCFYVELIRGRKEETEVLWTSNSIVVFCGTSGTYGTGSWPDGADLNLMPI

SEQ ID NO: 26252 - protein, 469 aa, Artificial Sequence
  neuraminidase__InfluenzaA__EPI675797
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNKVRDRTPYRTLLMNELGVPFHLGTKQVCIAWSSSSCHDGKAWLHVCITGDDKNATASFIYNGRLVDSVVSWSKDILRTQESECICINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQTNRQVIVDRGDRSGYSGIFSVEGKSCINRCFYVELIRGRKEETEVLWTSNSIVVFCGTSGTYGTGSWPDGADLNLMPI

SEQ ID NO: 26253 - protein, 469 aa, Artificial Sequence; identical to SEQ ID NO: 26251
  neuraminidase__InfluenzaA__EPI578429

SEQ ID NO: 26254 - protein, 469 aa, Artificial Sequence; identical to SEQ ID NO: 26251
  neuraminidase__InfluenzaA__EPI614405

SEQ ID NO: 26255 - protein, 449 aa, Artificial Sequence; identical to SEQ ID NO: 26173
  neuraminidase__InfluenzaA__AAT73329

SEQ ID NO: 26256 - protein, 449 aa, Artificial Sequence; identical to SEQ ID NO: 26173
  neuraminidase__InfluenzaA__AAW80723

SEQ ID NO: 26257 - protein, 449 aa, Artificial Sequence; identical to SEQ ID NO: 26173
  neuraminidase__InfluenzaA__EF541467

SEQ ID NO: 26258 - protein, 465 aa, Artificial Sequence; identical to SEQ ID NO: 23454
  neuraminidase__InfluenzaA__EPI439509

SEQ ID NO: 26259 - protein, 469 aa, Artificial Sequence
  neuraminidase__InfluenzaA__EPI482776
MNTNQRIITIGTVCMIVGIISLLLQIGNIVSLWISHSIQTGWENHTVMCNQSVITYVNNTWVNRTYVNISNIKIATIQDVTSIILAGNSSLCPVSGWAVYSKDNSIRIGSKGDIFVIREPFISCSQLECRTFFLTQGALLNDKHSNGTVKDRSPYRTLMSCPIGEAPSPYNSRFESVAWSASACHDGMGWLTIGISGPDNGAVAVLKYNGIITDTIKSWRNKILRTQESECVCMNGSCFTVLTDGPSNGQASYKIFKVEKGKIIKSIELDAPNYHYEECSCYPDTGKVMCVCRDNWHASNRPWVSFNQNLDYQIGYICSGVFGDNPRSNDGKGNCGPVLSNGANGVKGFSYRYGNGVWIGRTKSINSRSGFEMIWDPNGWTETDSSFSMKQDIIALNDWSGYSGSFVQHPELTGMNCIRPCFWVELIRGQPKESTIWASGSSISFCGVNSETASWSWPDGADLPFTIDK

SEQ ID NO: 26260 - protein, 469 aa, Artificial Sequence
  neuraminidase__InfluenzaA__EPI745533
MNPNQKIITIGSVCITIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGISWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIKPCFWVELIRGRPKENTIWTSGSSISFCGVNSDTVGWSWPDGAELPFTIDK

SEQ ID NO: 26261 - protein, 469 aa, Artificial Sequence; identical to SEQ ID NO: 16728
  neuraminidase__InfluenzaA__AEE69012

SEQ ID NO: 26262 - protein, 469 aa, Artificial Sequence; identical to SEQ ID NO: 16728
  neuraminidase__InfluenzaA__EPI176609

SEQ ID NO: 26263 - protein, 469 aa, Artificial Sequence; identical to SEQ ID NO: 16728
  neuraminidase__InfluenzaA__EPI176472

SEQ ID NO: 26264 - protein, 469 aa, Artificial Sequence
  neuraminidase__InfluenzaA__EPI280340
MNPNQKIITIGSVCITIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGISWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEIIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 26265 - protein, 469 aa, Artificial Sequence; identical to SEQ ID NO: 16728
  neuraminidase__InfluenzaA__EPI240318

SEQ ID NO: 26266 - protein, 469 aa, Artificial Sequence; identical to SEQ ID NO: 16728
  neuraminidase__InfluenzaA__EPI183133

SEQ ID NO: 26267 - protein, 469 aa, Artificial Sequence; identical to SEQ ID NO: 16728
  neuraminidase__InfluenzaA__EPI369141

SEQ ID NO: 26268 - protein, 469 aa, Artificial Sequence
  neuraminidase__InfluenzaA__EPI482787
MNTNQRIITIGTVCLIVGIVSLLLQIGNIVSLWISHSIQTGKRSHPETCSQNVITYENNTWVNQTYVNISNTNIVDGQGVTSIILAGNSPLCPISGWAIYSKDNSIRIGSKGDIFVIREPFISCSHLECRTFFLTQGALLNDRHSNGTVKDRSPYRTLMSCPIGEAPSPYNSRFESVAWSASACHDGMGWLTIGISGPDNGAVAVLKYNGIITDTIKSWRNKILRTQESECVCINGSCFTIMTDGPSNGQASYKIFKMEKGKIIKSVELDAPNYHYEECSCYPDTGKVVCVCRDNWHASNRPWVTFDQNLNYQIGYICSGVFGDNPRSNDGKGNCGPVPSNGANGVKGFSFRYGNGVWIGRTKSISSRSGFEMIWDPNGWTETDSSFSIKQDIIALTDWSGYSGSFVQHPELTGMNCIKPCFWVELIRGQPKESTIWTSGSSISFCGVDSETVSWSWPDGADLPFTIDK

SEQ ID NO: 26269 - protein, 469 aa, Artificial Sequence
  neuraminidase__InfluenzaA__EPI482790
MNTNQRIITIGTVCLIVGIISLLLQIGNMVSLWISHSIQTGGKNHTEMCNQNVITYVNNTWVNRTYVNISNTKIVNVQDVVSVILTGNSSLCPISGWAIYSKDNSIRIGSKGDIFVIREPFISCSHLECRTFFLTQGALLNDKHSNGTVKDRSPYRTLMSCPVGEAPSPYNSRFESVAWSASACHDGMGWLTIGISGPDNGAVAVLKYNGIITDTIKSWRNKILRTQESECVCMNGSCFTVLTDGPSNGQASYKIFKMEKGKIIKSIELDAPNYHYEECSCYPDAGKVMCVCRDNWHASNRPWVSFDQNLDYQIGYICSGVFGDNPRSNDGKGNCGPVHSNGANGVKGFSYRYGNGVWIGRTKSINSRSGFEMIWDPNGWTGTDSSFSMKQDIIALTDWSGYSGSFVQHPELTGMNCIRPCFWVELIRGQPKENTIWASGSSISFCGVNGETASWSWPDGADLPFTIDK

SEQ ID NO: 26270 - protein, 469 aa, Artificial Sequence
  neuraminidase__InfluenzaA__EPI291797
MNTNQRIITIGTVCMIVGIISLLLQIGNIVSLWISHSIQTGWENHTEMCNQSVITYVNNTWVNRTYVNISNTNIATIQDVTSIILAGNSSLCPVSGWAIYSKDNSIRIGSKGDIFVIREPFISCSQLECRTFFLTQGALLNDKHSNGTVKDRSPYRTLMSCPIGEAPSPYNSRFESVAWSASACHDGMGWLTIGISGPDNGAVAVLKYNGIITDTIKSWRNKILRTQESECVCMNGSCFTVLTDGPSNGQASYKIFKVEKGKIIKSIELDAPNYHYEECSCYPDTGKVMCVCRDNWHASNRPWVSFNQNLDYQIGYICSGVFGDNPRSNDGKGNCGPVLSNGANGVKGFSYRYGNGVWIGRTKSINSRSGFEMIWDPNGWTETDSSFSMKQDIIALTDWSGYSGSFVQHPELTGMNCIRPCFWVELIRGQPKESTIWASGSSISFCGVNSETASWSWPDGADLPFTIDK

SEQ ID NO: 26271 - protein, 469 aa, Artificial Sequence; identical to SEQ ID NO: 26270
  neuraminidase__InfluenzaA__EPI482798

SEQ ID NO: 26272 - protein, 469 aa, Artificial Sequence
  neuraminidase__InfluenzaA__EPI638969
MNTNQRIITIGTVCMIVGMISLLLQIGSIVSLWISHSIQTGWENHTGVCNQSVITYVNNTWVNRTYVNISNIKIATIQDVTPIILAGNSSLCPVNGWAVYSKDNSIRIGSKGDIFVIREPFISCSQLECRTFFLTQGALLNDKHSNGTVKDRSPYRTLMSCPIGEAPSPYNSRFESVAWSASACHDGMGWLTIGISGPDNGAVAVLKYNGIITDTIKSWRNKILRTQESECVCMNGSCFTVLTDGPSNGQASYKIFKVEKGKIIKSIELDAPNYHYEECSCYPDTGKVMCVCRDNWHASNRPWVSFNQNLDYQIGYICSGVFGDNPRSTDGKGNCGPVLSNGANGVKGFSYRYGNGVWIGRTKSINSRSGFEMIWDPNGWTETDSSFSMKQDIIALNDYSGYSGSFVQHPELTGMNCIRPCFWVELIRGQPKESTIWASGSSISFCGVNSETASWSWPDGADLPFAIDK

SEQ ID NO: 26273 - protein, 469 aa, Artificial Sequence
  neuraminidase__InfluenzaA__ABI19012
MNTNQRIITIGTVCLIVGIISLLLQIGNMVSLWISHSIQTGGKNHTEMCNQNVITYVNNTWVNRTYVNISNTKIVNVQDVVSVILTGNSSLCPISGWAIYSKDNSIRIGSKGDIFVIREPFISCSHLECRTFFLTQGALLNDKHSNGTVKDRSPYRTLMSCPIGEAPSPYNSRFESVAWSASACHDGMGWLTIGISGPDNGAVAVLKYNGIITDTIKSWRNKILRTQESECVCMNGSCFTVLTDGPSNGQASYKIFKMEKGKIIKSIELDAPNYHYEECSCYPDAGKVMCVCRDNWHASNRPWVSFDQNLDYQIGYICSGVFGDNPRSNDGKGNCGPVHSNGANGVKGFSYRYGNGVWIGRTKSINSRSGFEMIWDPNGWTGTDSSFSMKQDIIALTDWSGYSGSFVRHPELTGMNCIRPCFWVELIRGQPKENTIWASGSSISFCGVNGETASWSWPDGADLPFTIDK

SEQ ID NO: 26274 - protein, 469 aa, Artificial Sequence
  neuraminidase__InfluenzaA__EPI687791
MNPNQKIITIGSICMTIGMANLILQIGNIISIWVSHSIQIGNQSQIETCNQSVITYENNTWVNQTYVNISNTNFAARQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIIKSVEMKAPNYHYEECSCYPDSSEITCVCRDNWHGSNRPWVSFNQNLEYQMGYICSGVFGDNPRPNDKTGSCGPVSSNGANGVKGFSFKYGNGVWIGRTKSISSRKGFEMIWDPNGWTGTDNKFSIKQDIVGINEWSGYSGSFVQHPELTGLDCIRPCFWVELIRGRPEENTIWTSGSSISFCGVNSDTVGWSWPDGAELPFTIDK

SEQ ID NO: 26275 - protein, 469 aa, Artificial Sequence
  neuraminidase__InfluenzaA__EPI841266
MNPNQKIITIGSICMTIGMANLILQIGNIISIWVSHSIQIGNQSQIETCNQSVITYENNTWVNQTYVNISNTNFAARQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEEGKIIKSVEMKAPNYHYEECSCYPDSSEITCVCRDNWHGSNRPWVSFNQNLEYQMGYICSGVFGDNPRPNDKTGSCGPVSSNGANGVKGFSFKYGNGVWIGRTKSISSRKGFEMIWDPNGWTGTDNKFSIKQDIVGINEWSGYSGSFVQHPELTGLDCIRPCFWVELIRGRPEENTIWTSGSSISFCGVNSDTVGWSWPDGAELPFTIDK

SEQ ID NO: 26276 - protein, 469 aa, Artificial Sequence
  neuraminidase__InfluenzaA__EPI291844
MNTNQRIITIGTVCLIVGIISLLLQIGTMVSLWISHSIQTGGKNHTEMCNQNVITYVNNTWVNRTYVNISNTKIVNVQDVVSVILTGNSSLCPISGWAIYSKDNSIRIGSKGDIFVIREPFISCSHLECRTFFLTQGALLNDKHSNGTVKDRSPYRTLMSCPIGEAPSPYNSRFESVAWSASACHDGMGWLTIGISGPDNGAVAVLKYNGIITDTIKSWRNKILRTQESECVCMNGSCFTVLTDGPSNGQASYKIFKMEKGKIIKSIELDAPNYHYEECSCYPDAGKVMCVCRDNWHASNRPWVSFDQNLDYQIGYICSGVFGDNPRSNDGKGNCGPVHSNGANGVKGFSYKYGNGVWIGRTKSINSRSGFEMIWDPNGWTGTDSSFSMKQDIIALTDWSGYSGSFVQHPELTGMNCIRPCFWVELIRGQPKENTIWASGSSISFCGVNGETASWSWPDGADLPFTIDK

SEQ ID NO: 26277 - protein, 469 aa, Artificial Sequence
  neuraminidase__InfluenzaA__EPI558120
MNTNQRIITIGTVCMIVGIISLLLQIGNIVSLWISHSIQTGWENHTEMCNQSVITYVNNTWMNRTYVNISNIKIATIQDVTSIVLAGNSSLCPVSGWAVYSKDNSIRIGSKGDIFVIREPFISCSQLECRTFFLTQGALLNDKHSNGTVKDRSPYRTLMSCPIGEAPSPYNSRFESVAWSASACHDGMGWLTIGISGPDNGAVAVLKYNGIITDTIKSWRNKILRTQESECVCINGSCFTVLTDGPSNGQASYKIFKVEKGKIIKSIELDAPNYHYEECSCYPDTGKVMCICRDNWHASNRPWVSFDQNLDYQIGYICSGVFGDNPRSNDGKGNCGPVLSNGANGVKGFSYRYGNGVWIGRTKSINSRSGFEMIWDPNGWTETDSSFSMKQDIIALNDWSGYSGSFVQHPELTGMNCIRPCFWVELIRGQPKESTIWASGSSISFCGVNSETASWSWPDGADLPFTIDK

SEQ ID NO: 26278 - protein, 469 aa, Artificial Sequence
  neuraminidase__InfluenzaA__EPI564138
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSKLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVVEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 26279 - protein, 469 aa, Artificial Sequence
  neuraminidase__InfluenzaA__ANM92825
MNPNQKIITIGSICMTIGMANLILQIGNIISIWVSHSIQIGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIIKSVEMKAPNYHYEECSCYPDSSEITCVCRDNWHGSNRPWVSFNQNLEYQMGYICSGVFGDNPRPNDKTGNCGPVSSNGANGVKGFSFKYGNGVWIGRTKSISSRKGFEMIWDPNGWTGTDNKFSIKQDIVGINEWSGYSGSFVQHPELTGLDCIRPCFWVELIRGRPEENTIWTSGSSISFCGVNSDTVGWSWPDGAELPFTIDK

SEQ ID NO: 26280 - protein, 469 aa, Artificial Sequence
  neuraminidase__InfluenzaA__EPI291694
MNTNQRIITIGTVCLIVGIVSLLLQIGNIVSLWISHSIQTGEKNHSEVCNQNIITYENKTWVNQTYVNISNTNIAEGQGVTSIILAGNSSLCPVSGWAIYSKDNSIRIGSKGDIFVIREPFISCSHLECRTFFLTQGALLNDRHSNGTVKDRSPYRTLMSCLTGEAPSPYNSRFESVAWSASACHDGMGWLTIGISGPDNGAVAVLKYNGIITDTIKSWRNKILRTQESECVCINGSCFTIMTDGPSNGQASYKIFKMEKGKIIKSVELDAPNYHYEECSCYPDTGKVVCVCRDNWHASNRPWVSFDQNLDYQIGYICSGVFGDNPRSNDGKGNCGPVPSNGANGVKGFSFRYGNGVWIGRTKSIISRSGFEMIWDPNGWTETDSSFSIKQDIIALTDWSGYSGSFVQHPELTGMNCIRPCFWVELIRGQPKESTIWTSGSSISFCGVDSETASWSWPDGADLPFTIDK

SEQ ID NO: 26281 - protein, 469 aa, Artificial Sequence; identical to SEQ ID NO: 17214
  neuraminidase__InfluenzaA__EPI241027

SEQ ID NO: 26282 - protein, 469 aa, Artificial Sequence; identical to SEQ ID NO: 16738
  neuraminidase__InfluenzaA__EPI177405

SEQ ID NO: 26283 - protein, 469 aa, Artificial Sequence; identical to SEQ ID NO: 16738
  neuraminidase__InfluenzaA__EPI242475

SEQ ID NO: 26284 - protein, 469 aa, Artificial Sequence
  neuraminidase__InfluenzaA__EPI590131
MNANQRIITIGTVCLIIGIISLLLQIGNMVSLWISHSIQTGGKNHTEMCNQNVITYVNNTWVNRTYVNISNTKIVNVQDVVSVILTGNSSLCSISGWAIYSKDNSIRIGSKGDIFVIREPFISCSHLECRTFFLTQGALLNDKHSNGTVKDRSPYRTLMSCPIGEAPSPYNSRFESVAWSASACHDGIGWLTIGISGPDNGAVAVLKYNGIITDTIKSWRNKILRTQESECVCMNGSCFAVLTDGPSNGQASYKIFKVKQGKIIKSIELDAPNYHYEECSCYPDAGKVMCVCRDNWHASNRPWVSFDQDLNYQIGYICSGVFGDNPRSNDGKGNCGPVHSNGANGVKGFSYRYGNGVWIGRTKSIHSRSGFEMIWDPNGWTGTDSSFSMKQDIIALTDWSGYSGSFVQHPELTGMNCIRPCFWVELIRGQPKENTIWASGSSISFCGVNGETASWSWPDGADLPFTIDK

SEQ ID NO: 26285 - protein, 469 aa, Artificial Sequence
  neuraminidase__InfluenzaA__EPI68596
MNTNQRIITIGTVCLIVGIVSLLLQIGNIVSLWISHSIQTGEKNHSEICSQNVITYENNTWVNQTYVNISNTNIADGQGVTSIILAGNSSLCPISGWAIYSKDNSIRIGSKGDIFVIREPFISCSHLECRTFFLTQGALLNDRHSNGTVKDRSPYRTLMSCPIGEAPSPYNSRFESVAWSASACHDGMGWLTIGISGPDNGAVAVLKYNGIITDTIKSWRNKILRTQESECVCINGSCFTIMTDGPSNGQASYKIFKMEKGKIIKSVELDAPNYHYEECSCYPDTGKVVCVCRDNWHASNRPWVSFDQNLDYQIGYICSGVFGDNPRSNDGKGNCGPVLSNGANGVKGFSFRYGNGVWIGRTKSISSRSGFEMIWDPNGWTETDSSFSIKQDIIALTDWSGYSGSFVQHPELTGMNCIRPCFWVELIRGQPKESTIWTSGSSISFCGVDSETASWSWPDGADLPFTIDK

SEQ ID NO: 26286 - protein, 454 aa, Artificial Sequence; identical to SEQ ID NO: 15719
  neuraminidase__InfluenzaA__EPI115409

SEQ ID NO: 26287 - protein, 454 aa, Artificial Sequence; identical to SEQ ID NO: 15719
  neuraminidase__InfluenzaA__ABD77678/m1

SEQ ID NO: 26288 - protein, 469 aa, Artificial Sequence; identical to SEQ ID NO: 16728
  neuraminidase__InfluenzaA__EPI185224

SEQ ID NO: 26289 - protein, 469 aa, Artificial Sequence; identical to SEQ ID NO: 26244
  neuraminidase__InfluenzaA__EPI697745

SEQ ID NO: 26290 - protein, 469 aa, Artificial Sequence; identical to SEQ ID NO: 26244
  neuraminidase__InfluenzaA__EPI768524

SEQ ID NO: 26291 - protein, 469 aa, Artificial Sequence
  neuraminidase__InfluenzaA__EPI726929
MNPNQKIITIGSISMTIGMANLILQIGNIISIWVSHSIQIGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIIKSVEMKAPNYHYEECSCYPDSSEITCVCRDNWHGSNRPWVSFNQNLEYQMGYICSGVFGDNPRPNDKTGSCGPVSSNGANGVKGFSFKYGNGVWIGRTKSISSRKGFEMIWDPNGWTGTDNKFSIKQDIVGINEWSGYSGSFVQHPELTGLDCIRPCFWVELIRGRPEENTIWTSGSSISFCGVNSDTVGWSWPDGAELPFTIDK

SEQ ID NO: 26292 - protein, 469 aa, Artificial Sequence; identical to SEQ ID NO: 26291
  neuraminidase__InfluenzaA__EPI813816

SEQ ID NO: 26293 - protein, 469 aa, Artificial Sequence
  neuraminidase__InfluenzaA__EPI466627
MNPNQKIITIGSVCMTIGMANLILQIGNIISIWVSHSIQLGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPEENTIWTSGSSISFCGVNSDTVGWSWPDGAELPFTIDK

SEQ ID NO: 26294 - protein, 469 aa, Artificial Sequence
  neuraminidase__InfluenzaA__EPI541965
MNPNQKIITIGSVCMTIGMANLILQIGNIISIWVSHSIQLGNQSQIETCNQSVITYENNTWVNQTYVNISNTNFAAGQPVVSVKLAGNSSLCPVSGWAIYSKDNSVRIGSKGDVFVIREPFISCSPLECRTFFLAQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPEENTIWTSGSSISFCGVNSDTVGWSWPDGAELPFTIDK

SEQ ID NO: 26295 - protein, 469 aa, Artificial Sequence
  neuraminidase__InfluenzaA__EPI652004
MNPNQKIITIGSVCMTIGMANLILQIGNIISIWVSHSIQIGNQSQIETCNQSVITYENNTWVNQTYVNISNTNFAAGQSVVSVKLAGNSSLCPVSGWAIYSKDNSVRIGSKGDVFVIREPFISCSPLECRTFFLAQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPEENTIWTSGSSISFCGVNSDTVGWSWPDGAELPFTIDK

SEQ ID NO: 26296 - protein, 469 aa, Artificial Sequence
  neuraminidase__InfluenzaA__EPI62526
MNTNQRIITIGTVCLIVGIVSLLLQIGNIVSLWISHSIQTGEKNHPEICSQNVITYENNTWVNQTYVNISNTNIVDGQGVTSIILAGNSSLCPISGWAIYSKDNSIRIGSKGDIFVIREPFISCSHLECRTFFLTQGALLNDRHSNGTVKDRSPYRTLMSCPIGEAPSPYNSRFESVAWSASACHDGMGWLTIGISGPDNGAVAVLKYNGIITDTIKSWRNKILRTQESECVCINGSCFTIMTDGPSNGQASYKIFKMEKGKIIKSVELDAPNYHYEECSCYPDTGKVVCVCRDNWHASNRPWVSFDQNLDYQIGYICSGVFGDNPRSNDGKGNCGPVLSNGANGVKGFSFRYGNGVWIGRTKSISSRSGFEMIWDPNGWTETDSSFSIKQDIIALTDWSGYSGSFVQHPELTGMNCIRPCFWVELIRGQPKESTIWTSGSSISFCGVDSETASWSWPDGADLPFTIDK

SEQ ID NO: 26297 - protein, 469 aa, Artificial Sequence; identical to SEQ ID NO: 16728
  neuraminidase__InfluenzaA__EPI189183

SEQ ID NO: 26298 - protein, 469 aa, Artificial Sequence; identical to SEQ ID NO: 16728
  neuraminidase__InfluenzaA__EPI180576

SEQ ID NO: 26299 - protein, 469 aa, Artificial Sequence
  neuraminidase__InfluenzaA__EPI346918
MNTNQRIITIGTVCMIVGIISLLLQIGNIVSLWISHSIQTGWENHTEMCNQNVITYVNNTWVNRTYVNVSNTNIATIQDVTSIVLAGNSSLCPVSGWAIYSKDNSIRIGSKGDIFVIREPFISCSQLECRTFFLTQGALLNDKHSNGTVKDRSPYRTLMSCPIGEAPSPYNSRFESVAWSASACHDGMGWLTIGISGPDNGAVAVLKYNGIITDTIKSWRNKILRTQESECVCMNGSCFTVLTDGPSNGQASYKIFKVEKGRIIKSIELDAPNYHYEECSCYPDTGKVMCVCRDNWHASNRPWVSFNQNLDYQIGYICSGVFGDNPRSNDGKGNCGPVLSNGANGVKGFSYRYGNGVWIGRTKSINSRRGFEIIWDPNGWTETDSSFSMKQDIIALTDWSGYSGSFVQHPELTGMNCIRPCFWVELIRGQPKESTIWASGSSISFCGVNSETASWSWPDGADLPFTIDK

SEQ ID NO: 26300 - protein, 469 aa, Artificial Sequence; identical to SEQ ID NO: 17316
  neuraminidase__InfluenzaA__EPI240976

SEQ ID NO: 26301 - protein, 469 aa, Artificial Sequence; identical to SEQ ID NO: 14095
  neuraminidase__InfluenzaA__EPI3165

SEQ ID NO: 26302 - protein, 469 aa, Artificial Sequence; identical to SEQ ID NO: 26021
  neuraminidase__InfluenzaA__EPI957

SEQ ID NO: 26303 - protein, 469 aa, Artificial Sequence; identical to SEQ ID NO: 22146
  neuraminidase__InfluenzaA__EPI507593

SEQ ID NO: 26304 - protein, 469 aa, Artificial Sequence; identical to SEQ ID NO: 22146
  neuraminidase__InfluenzaA__EPI461954

SEQ ID NO: 26305 - protein, 469 aa, Artificial Sequence; identical to SEQ ID NO: 22146
  neuraminidase__InfluenzaA__EPI461954

SEQ ID NO: 26306 - protein, 469 aa, Artificial Sequence
  neuraminidase__InfluenzaA__EPI668104
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFYLGTKQVCIAWSSSSCHDGKAWLHVCITGDDKNATASFIYNGRLVDSVVSWSKDILRTQESECVCINGTCTVVMTDGNASGKADTKILFIEEGKIVHTSKLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVVEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 26307 - protein, 469 aa, Artificial Sequence
  neuraminidase__InfluenzaA__EPI578445
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGNASGKADTKILFIEEGKIVHTSKLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVVEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 26308 - protein, 469 aa, Artificial Sequence; identical to SEQ ID NO: 26307
  neuraminidase__InfluenzaA__EPI551883

SEQ ID NO: 26309 - protein, 469 aa, Artificial Sequence
  neuraminidase__InfluenzaA__EPI344388
MNPNQKIITIGSVSLIIATICFLMQIAILVTTVTLHFKQHDYNSPPNNQAMLCEPTIIERNTTEIVYLTNTTIEKEICPKLAEYRNWSKPQCNITGFAPFSKDNSIRLSAGGDIWVTREPYVSCDPDKCYQFALGQGTTLNNGHSNNTVHDRTPYRTLLMNELGVPFHLGTRQVCMAWSSSSCHDGKAWLHVCITGNDNNATASFIYNGRLVDSIGSWSKNILRTQESECVCINGTCTVVMTDGSASGKADTKILFVEEGKIVHISTLSGSAQHVEECSCYPRFPGVRCVCRDNWKGSNRPIVDINVKNYSIVSSYVCSGLVGDTPRKSDSVSSSYCLDPNNEKGGHGVKGWAFDDGNDVWMGRTINETLRLGYETFKVIEGWSKANSKLQTNRQVIVEKGDRSGYSGIFSVEGKSCINRCFYVELIRGRKEETKVWWTSNSIVVFCGTSGTYGTGSWPDGADINLMPI

SEQ ID NO: 26310 - protein, 469 aa, Artificial Sequence; identical to SEQ ID NO: 26309
  neuraminidase__InfluenzaA__EPI347601

SEQ ID NO: 26311 - protein, 469 aa, Artificial Sequence
  neuraminidase__InfluenzaA__EPI642512
MNPNQKIITIGSISLIIATICFLMQIAILVITVTLHFKQHNCDSSPNNQVMFCEPTIIERNKTEIVYLINTTVEKEICPKPTEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCITGDDGNATASFIYNGRLVDSIGSWSKNILRTQESECVCINGTCTVVMTDGSASGKADTKILFIEEGKIIHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKSRLGYETFKVVKGWSEPNSKLQTNRQVIVGRGNRSGYSGIFSIEGKNCINRCFYVELIRGRKEETKVWWTSNSIVVFCGTSGTYGTGSWPDGADINLMPI

SEQ ID NO: 26312 - protein, 469 aa, Artificial Sequence
  neuraminidase__InfluenzaA__AIE52540
MNPNQKIITIGSVSLIIATICFLMQIAILVTTVTLHFKQHDYNSPPNNQVMLCEPTIIERNTTEIVYLTNITIEKEICPKLAEYRNWSKPQCNITGFAPFSKDNSIRLSAGGDIWVTREPYVSCDPDKCYQFALGQGTTLNNRHSNNTVHDRSPYRTLLMNELGVPFHLGTRQVCIAWSSSSCHDGKAWLHVCITGDDNNATASFIYNGRLVDSIGSWSKNILRTQESECVCINGTCTVVMTDGSASGKADTKILFIEEGKIVHISTLSGSAQHVEECSCYPRYPGVRCVCRDNWKGSNRPIVDINMKDYSIASSYVCSGLVGDTPRKNDSFSSSHCLDPNNEKGGHGVKGWAFDDGNDVWMGRTISEEFRLGYETFKVIKGWSNPNSKLQTNRQVIVEKGNRSGYSGVFSIEDKSCINRCFYVELIRGRKEETKVWWTSNSIVVFCGTSGTYGTGSWPDGADINLMPI

SEQ ID NO: 26313 - protein, 469 aa, Artificial Sequence; identical to SEQ ID NO: 26312
  neuraminidase__InfluenzaA__EPI465399

SEQ ID NO: 26314 - protein, 469 aa, Artificial Sequence; identical to SEQ ID NO: 26312
  neuraminidase__InfluenzaA__EPI328899

SEQ ID NO: 26315 - protein, 469 aa, Artificial Sequence; identical to SEQ ID NO: 26312
  neuraminidase__InfluenzaA__EPI328901

SEQ ID NO: 26316 - protein, 469 aa, Artificial Sequence
  neuraminidase__InfluenzaA__EPI574645
MNPNQKIITIGSVSLTISTICFFMQIAILITTVTLHFKQYEFNSPPNNQVVLCEPTIIERNITEIVYLTNTTIEKEICPKPAEYRNWSKPQCGITGFAPFSKDNSIRLSAGGDIWVTREPYVSCDPDKCYQFALGQGTTLNNGHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIIHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEENEVLWTSNSIVVFCGTSGTYGTGSWPDGADLNLMPI

SEQ ID NO: 26317 - protein, 469 aa, Artificial Sequence
  neuraminidase__InfluenzaA__EPI563214
MNPNQKIITIGSVSLTISTICFFMQIAILITTVTLHFKQYEFNSPPNNQVMLCEPTIIERNITEIVYLTNTTIEKEICPKPAEYRNWSKPQCSITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVYTSKLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVVEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 26318 - protein, 469 aa, Artificial Sequence; identical to SEQ ID NO: 26317
  neuraminidase__InfluenzaA__EPI553998

SEQ ID NO: 26319 - protein, 469 aa, Artificial Sequence
  neuraminidase__InfluenzaA__EPI551568
MNPNQKIITIGSVSLTISTICFFMQIAILITTVTLHFKQYEFNSPPNNQVMLCEPTIIERNITEIVYLTNTTIEKEICPKPAEYRNWSKPQCSITGFAPFSKDNSIRLSAGGDIWVTREPYVSCDPDKCYQFALGQGTTLNNVHSNNIVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVYTSKLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVVEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 26320 - protein, 469 aa, Artificial Sequence
  neuraminidase__InfluenzaA__EPI629737
MNPNQKIIAIGSVSLTISTICFFMQIAILITTVTLHFKQYEFNSPPNNQVMLCEPTIIERNITEIVYLTNTTIEKEICPKPAEYRNWSKPQCSITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVYTSKLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVVEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 26321 - protein, 469 aa, Artificial Sequence; identical to SEQ ID NO: 26317
  neuraminidase__InfluenzaA__EPI631886

SEQ ID NO: 26322 - protein, 469 aa, Artificial Sequence; identical to SEQ ID NO: 26317
  neuraminidase__InfluenzaA__EPI577025

SEQ ID NO: 26323 - protein, 469 aa, Artificial Sequence; identical to SEQ ID NO: 23871
  neuraminidase__InfluenzaA__EPI404926

SEQ ID NO: 26324 - protein, 469 aa, Artificial Sequence; identical to SEQ ID NO: 23871
  neuraminidase__InfluenzaA__EPI492687

SEQ ID NO: 26325 - protein, 469 aa, Artificial Sequence
  neuraminidase__InfluenzaA__EPI530648
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQTNRQVIVDRGDRSGYSGIFSVEGKSCINRCFYVELIRGRKEETEVLWTSNSIVVFCGTSGTYGTGSWPDGADLNLMPI

SEQ ID NO: 26326 - protein, 469 aa, Artificial Sequence; identical to SEQ ID NO: 26307
  neuraminidase__InfluenzaA__EPI684314

SEQ ID NO: 26327 - protein, 469 aa, Artificial Sequence
  neuraminidase__InfluenzaA__EPI614459
MNPNQKIITIGSVSLTISTICFFMQIAILITTVTLHFKQYKFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQTNRQVIVDRGDRSGYSGIFSVEGKSCINRCFYVELIRGRKEETEVLWTSNSIVVFCGTSGTYGTGSWPDGADLNLMPI

SEQ ID NO: 26328 - protein, 469 aa, Artificial Sequence; identical to SEQ ID NO: 26327
  neuraminidase__InfluenzaA__EPI541466

SEQ ID NO: 26329 - protein, 469 aa, Artificial Sequence; identical to SEQ ID NO: 26327
  neuraminidase__InfluenzaA__EPI696968

SEQ ID NO: 26330 - protein, 469 aa, Artificial Sequence; identical to SEQ ID NO: 26327
  neuraminidase__InfluenzaA__EPI674598

SEQ ID NO: 26331 - protein, 469 aa, Artificial Sequence; identical to SEQ ID NO: 26325
  neuraminidase__InfluenzaA__EPI530678

SEQ ID NO: 26332 - protein, 469 aa, Artificial Sequence
  neuraminidase__InfluenzaA__EPI530680
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNGVWMGRTINETSRLGYETFKVIEGWSNPKSKLQTNRQVIVDRGDRSGYSGIFSVEGKSCINRCFYVELIRGRKEETEVLWTSNSIVVFCGTSGTYGTGSWPDGADLNLMPI

SEQ ID NO: 26333 - protein, 469 aa, Artificial Sequence; identical to SEQ ID NO: 14038
  neuraminidase__InfluenzaA__EPI7603

SEQ ID NO: 26334 - protein, 469 aa, Artificial Sequence; identical to SEQ ID NO: 26325
  neuraminidase__InfluenzaA__EPI814527

SEQ ID NO: 26335 - protein, 469 aa, Artificial Sequence; identical to SEQ ID NO: 26325
  neuraminidase__InfluenzaA__EPI674737

SEQ ID NO: 26336 - protein, 469 aa, Artificial Sequence; identical to SEQ ID NO: 26325
  neuraminidase__InfluenzaA__EPI614443

SEQ ID NO: 26337 - protein, 469 aa, Artificial Sequence; identical to SEQ ID NO: 26325
  neuraminidase__InfluenzaA__EPI551812

SEQ ID NO: 26338 - protein, 469 aa, Artificial Sequence; identical to SEQ ID NO: 26325
  neuraminidase__InfluenzaA__EPI696961

SEQ ID NO: 26339 - protein, 469 aa, Artificial Sequence; identical to SEQ ID NO: 26325
  neuraminidase__InfluenzaA__EPI740789

SEQ ID NO: 26340 - protein, 469 aa, Artificial Sequence
  neuraminidase__InfluenzaA__EPI377498
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVHDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 26341 - protein, 469 aa, Artificial Sequence; identical to SEQ ID NO: 26340
  neuraminidase__InfluenzaA__EPI377498

SEQ ID NO: 26342 - protein, 469 aa, Artificial Sequence; identical to SEQ ID NO: 26340
  neuraminidase__InfluenzaA__EPI391246

SEQ ID NO: 26343 - protein, 469 aa, Artificial Sequence; identical to SEQ ID NO: 26340
  neuraminidase__InfluenzaA__EPI407122

SEQ ID NO: 26344 - protein, 469 aa, Artificial Sequence; identical to SEQ ID NO: 26340
  neuraminidase__InfluenzaA__EPI407125

SEQ ID NO: 26345 - protein, 469 aa, Artificial Sequence; identical to SEQ ID NO: 26307
  neuraminidase__InfluenzaA__EPI562038

SEQ ID NO: 26346 - protein, 469 aa, Artificial Sequence; identical to SEQ ID NO: 26307
  neuraminidase__InfluenzaA__EPI562038

SEQ ID NO: 26347 - protein, 469 aa, Artificial Sequence; identical to SEQ ID NO: 22617
  neuraminidase__InfluenzaA__EU716525

SEQ ID NO: 26348 - protein, 449 aa, Artificial Sequence
  neuraminidase__InfluenzaA__EPI232422
MNPNQKIITIGSICMVIGIVSLMLQIGNMISIWVSHSIQTGNQRQAEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 26349 - protein, 449 aa, Artificial Sequence; identical to SEQ ID NO: 26184
  neuraminidase__InfluenzaA__EPI227593

SEQ ID NO: 26350 - protein, 449 aa, Artificial Sequence
  neuraminidase__InfluenzaA__EPI435658
MNPNQKIVTIGSICMVIGIISLMLQIGNIISIWVSHSIQTGNQHQTEPIRNTNFLTENAVASVTLAGNSSLCPIRGWAVHSKDNSIRIGSKGDVFVIREPFISCSHLECRTFFLTQGALLNDKHSNGTVKDRSPHRTLMSCPIGEAPSPYNSRFESVAWSASACHDGTSWLIIGISGPDNGAVAVLKYNGIITDTIKSWRNNILRTQESECACVNGSCFTVMTDGPSNGQASYKIFKIEKGKVVKSVELNAPNYHYEECSCYPDAGEIICVCRDNWHGSNRPWVSFNQNLEYQIGYICSGVFGDNPRPNDGTGSCGPVSPNGAYGVKGFSFKYGNGVWIGRTKSTHSRSGFEMIWDPNGWTGTDSEFSMKQDIVAITDWSGYSGSFVQHPELTGLDCIRPCFWVELIRGRPKESTIWTSGSSISFCGVNSDTVSWSWPDGAELPFTIDK

SEQ ID NO: 26351 - protein, 449 aa, Artificial Sequence; identical to SEQ ID NO: 26350
  neuraminidase__InfluenzaA__EPI492513

SEQ ID NO: 26352 - protein, 449 aa, Artificial Sequence; identical to SEQ ID NO: 19697
  neuraminidase__InfluenzaA__EPI165066

SEQ ID NO: 26353 - protein, 449 aa, Artificial Sequence
  neuraminidase__InfluenzaA__EPI531308
MNPNQKIITIGSICMVTGVVSLMLQVGNMISIWISHSIHTGNQHQAEPISNTNFHTEKAVVSAKLAGNSSLCPINGWAVYSKDNSIRIGSKGDVFVIREPFISCSHLECRTFFLTQGALLNDKHSNGTAKDRSPHRTLMSCPVGEAPSPYNSRFESVAWSASACHDGTSWLTIGISGPDNGAVAVLKYNGIITDTIKSWRNNVLRTQESECACVNGYCFTVMTDGPSNGQASHKIFKMEKGKVIKSVELDAPNYHYEECSCYPDAGEITCVCRDNWHGSNRPWISFNQNLEYQIGYICSGVFGDNPRPNDGKGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKEGTIWTSGSSISFCGVSGDTVGWSWPDGAELPFTIDK

SEQ ID NO: 26354 - protein, 449 aa, Artificial Sequence
  neuraminidase__InfluenzaA__EPI433308
MNPNQKIITIGSICMVIGIVSLMLQIGNLISIWVSHSIQRGNLNQVEPISNTSFPTEKAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVVKYNGIITDTIKSWGNNILRTQESECACVNGSCFTVMTDGPSNGQASYKIFKMEKGKVIKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSPNSRSGFEMIWDPNGWSETDSSFSVKQDILAVTDWSGYSGSFVQHPELTGLDCIRPCFWVELIRGRPEESTIWTSGSSISFCGVNSDTVSWSWPDGAELPFTIDK

SEQ ID NO: 26355 - protein, 449 aa, Artificial Sequence
  neuraminidase__InfluenzaA__EPI114974
MNPNQKIITIGSICMVIGIVSLMLQIGNMISIWVSHSIQTGNQRQAEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSIELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 26356 - protein, 449 aa, Artificial Sequence
  neuraminidase__InfluenzaA__EPI622495
MNPNQKITTIGSICMVIGIVSLMLQIGNMVSIWVSHSIQTRNQRQAEPISNTRSLTEKAVASVTLAGNSSLCPISGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVVKYNGIITDTIKSWRNNILRTQESECVCVNGSCFTVMTDGPSNKQASYKIFKMEKGKVVKSIELDAPNYHYEECSCYPDAGEITCVCRDNWHGSNRPWLSFNQNLEYQIGYICSGVFGDNPRPNDGTGSCGPVSSNGAYGVKGFSFKYGNGVWIGRTKSTNSRSGFEMIWDPNGWTGTDSSFSMKQDIVAITDWSGYSGSFVQHPELTGLDCIRPCFWVELVRGRPKEGTIWTSGSSISFCGVNSDTVSWSWPDGAELPFTIDK

SEQ ID NO: 26357 - protein, 449 aa, Artificial Sequence
  neuraminidase__InfluenzaA__EPI349847
MNPNQKITTIGSICMVIGIVSLMLQIGNMVSIWVSHSIQTRNQRQAEPISNTRSLTEKAVASVTLAGNSSLCPISGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVVKYNGIITDTIKSWRNNILRTQESECVCVNGSCFTVMTDGPSNKQASYKIFKMEKGKVVKSIELDAPNYHYEECSCYPDAGEITCVCRDNWHGSNRPWLSFNQNLEYQIGYICSGVFGDNPRPNDGTGSCGPVSHNGAYGVKGFSFKYGNGVWIGRTKSTNSRSGFEMIWDPNGWTGTDSSFSMKQDIVAITDWSGYSGSFVQHPELTGLDCIRPCFWVELVRGRPKEGTIWTSGSSISFCGVNSDTVSWSWPDGAELPFTIDK

SEQ ID NO: 26358 - protein, 449 aa, Artificial Sequence
  neuraminidase__InfluenzaA__EPI174804
MNPNQKIITIGSICMVIGIVSLMLQIGNMVSIWVSHSIQTRNQRQAEPISNTKSLTEKAVASVTLAGNSSLCPISGWAVYSKDNSIRIGSKGDVFVIREPFISCSHLECRTFFLTQGALLNDKHSNGTIKDRSPHRTLMSCPVGEAPSPYNSRFESVAWSASACHDGTSWLTIGISGPDNGAVAVLKYNGIITDTIKSWRNNILRTQESECACVNGSCFAVMTDGPSNRQASYKIFKMEKGKVVKSIELDAPNYHYEECSCYPDAGEITCVCRDNWHGSNRPWLSFNQNLEYQIGYICSGVFGDNPRPNDGTGSCGPVSSNGAYGVKGFSFKYGNGVWIGRTKSTNSRSGFEMIWDPNGWTETDSSFSMKQDIVAITDWSGYSGSFVQHPELTGLDCIRPCFWVELVRGRPKESTIWTSGSSISFCGVNSDTVSWSWPDGAELPFTIDK

SEQ ID NO: 26359 - protein, 449 aa, Artificial Sequence
  neuraminidase__InfluenzaA__EPI492441
MNPNQKIMAIGSVCMVIGIVSLMLQIGNTISIWVSHSFQTRVQHQAEPIRNTNFLTENAVASVTLAGNSSLCPIRGWAVHSKDNSIRIGSKGDVFVIREPFISCSHLECRTFFLTQGALLNDKHSNRTVKDRSPHRTLMSCPVGEVPSPYNSRFESVAWSASACHDGTSWLTIGISGPDNGAVAVLKYNGIITDTIKSWRNNILRTQESECACVNGFCFTVMTDGPSNGQASYKIFKMKKGKVVKSVELNAPNYHYEECSCYPDAGEIMCVCRDNWHGSNRPWVSFNQNLEYQIGYICSGVFGDNPRPNDGTGSCGPVSPNGAYGIKGFSFKYGNGVWIGRTKSTNSRSGFEMVWDPNGWTDTDSDFSIKQDIVAITDWSGYSGSFVQHPELTGLDCIRPCFWVELIRGRPKESTIWTSGSSISFCGVNSETVSWSWPDGAELPFTIDK

SEQ ID NO: 26360 - protein, 449 aa, Artificial Sequence; identical to SEQ ID NO: 25987
  neuraminidase__InfluenzaA__EPI164142

SEQ ID NO: 26361 - protein, 449 aa, Artificial Sequence
  neuraminidase__InfluenzaA__EPI827076
MNPNQKIVTIGSICMVIGIISLMLQIGNIISIWVSHSIQTGNQHQTEPIRNTNFLTENAVASVTLAGNSSLCPIKGWAVHSKDNSIRIGSKGDVFVIREPFISCSHLECRTFFLTQGALLNDKHSNGTVKDRSPHRTLMSCPIGEAPSPYNSRFESVAWSASACHDGTSWLIIGISGPDNGAVAVLKYNGIITDTIKSWRNNILRTQESECACVNGSCFAVMTDGPSNGQASYKIFKIEKGKVVKSVELNAPNYHYEECSCYPDAGEIICVCRDNWHGSNRPWVSFNQNLEYQIGYICSGVFGDNPRPNDGTGSCGPVSSNGAYGVKGFSFKYGNGVWIGRTKSTHSRSGFEMIWDPNGWTGTDSEFSMKQDIVAITDWSGYSGSFVQHPELTGLDCIRPCFWVELIRGRPKESTIWTSGSSISFCGVNSDTVSWSWPDGAELPFTIDK

SEQ ID NO: 26362 - protein, 449 aa, Artificial Sequence; identical to SEQ ID NO: 16579
  neuraminidase__InfluenzaA__EPI168491

SEQ ID NO: 26363 - protein, 449 aa, Artificial Sequence
  neuraminidase__InfluenzaA__EPI827078
MNPNQKIITIGSICMVIGIASLMLQIGNIISIWISHSIQTGNQCQNESISNTKFLAEKAVASVTLAGNSSLCPVSGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDSGAVAVLKYNGIITDTIKSWRNNIMRTQESECACVNGSCFTIMTDGPSSGQASYKIFKMEKGKVIKSVELDAPNYHYEECSCYPDAGEITCVCRDNWHGSNRPWISFNQNLEYQIGYICSGVFGDNPRPNDGTGSCGPVFPNGAYGVKGFSFKYGNGVWIGRTKSTNSRSGFEMIWDPNGWTGTDSSFSVKQDIVAITEWSGYSGSFVQHPELTGLDCIRPCFWVELIRGRPKESTIWTSGSSISFCGVNGDTVSWSWPDGAELPFTIDK

SEQ ID NO: 26364 - protein, 449 aa, Artificial Sequence
  neuraminidase__InfluenzaA__EPI594521
MNPNQKIITIGSICVGIGIVSLMLQIGNMVSIWVNHSIQTENQCQAESISNTKFLTEKAVAPVTLMGNSSLCPISGWAVHSKDNSIRIGSKGDVFVIREPFISCSHLECRTFFLTQGALLNDKHSNGTVKDRSPHRALMSCPVGEAPSPYNSRFESVAWSASACHDGTGWLTIGISGPDNGAVAVLKYNGIITDTIKSWRNNILRTQESECACVNGSCFTVMTDGPSNGQASYKIFKLEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAEVPFTIDK

SEQ ID NO: 26365 - protein, 469 aa, Artificial Sequence
  neuraminidase__InfluenzaA__EPI5787
MNPNQKIITIGSICMVVGIISLMLQIGNIISIWVSHSIQTGNQHQAEPCNQSIITYENNTWVNQTYVNISNTNFLTEKAVASVTLAGNSSLCPISGWAVHSKDNGIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELNAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVGWSWPDDAELPFTIDK

SEQ ID NO: 26366 - protein, 469 aa, Artificial Sequence; identical to SEQ ID NO: 26365
  neuraminidase__InfluenzaA__EPI5787

SEQ ID NO: 26367 - protein, 449 aa, Artificial Sequence; identical to SEQ ID NO: 21065
  neuraminidase__InfluenzaA__EPI267031

SEQ ID NO: 26368 - protein, 449 aa, Artificial Sequence; identical to SEQ ID NO: 22645
  neuraminidase__InfluenzaA__EPI376539

SEQ ID NO: 26369 - protein, 449 aa, Artificial Sequence
  neuraminidase__InfluenzaA__EPI124069
MNPNQKIITIGSICMVIGIVSLMLQIGNMISIWVSHSIQTGNQHQAESISNTNPLTEKAVASVTLAGNSSLCPIRGWAVHSKDNNIRIGSKGDVFVIREPFISCSHLECRTFFLTQGALLNDKHSNGTVKDRSPHRTLMSCPVGEAPSPYNSRFESVAWSASACHDGTSWLTIGISGPDNEAVAVLKYNGIITDTIKSWRNNILRTQESECACVNGSCFTVMTDGPSDGQASYKIFKMEKGKVVKSVELDAPNYHYEECSCYPDAGEITCVCRDNWHGSNRPWVSFNQNLEYQIGYICSGVFGDNPRPNDGTGSCGPMSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 26370 - protein, 449 aa, Artificial Sequence
  neuraminidase__InfluenzaA__EPI342499
MNPNQKIITIGSICMVIGIVSLMLQIGNMISIWISHSIQKGNQHRTESISNTNPLTEKAVASVTLTGNSSLCPIRGWAVHSKDNNIRIGSKGDVFVIREPFISCSHLECRTFFLTQGALLNDKHSNGTVKDRSPHRTLMSCPLGEAPSPYNSRFESVAWSASACHDGTGWLTIGISGPDNEAVAVLKYNGIITDTIKSWRNNILRTQESECACVNGSCFTVMTDGPSNGQASYKIFKMRKGKVVKSVELDAPNYHYEECSCYPDTGEITCVCRDNWHGSNRPWISFNQNLEYQIGYICSGIFGDNPRPNDGTGSCGPMSPNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 26371 - protein, 449 aa, Artificial Sequence
  neuraminidase__InfluenzaA__EPI103069
MNPNQKIITIGSICMVIGIVSLMLQIGNMISIWVSHSIQTGNQRQAEPISNTKFLTEKAVASVTLAGNSSLCPISGWAVYSKDNSIRIGSRGDVFVIREPFISCSHLECRTFFLTQGALLNDKHSNGTIKDRSPHRTLMSCPVGEAPSPYNSRFESVAWSASACHDGTSWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 26372 - protein, 449 aa, Artificial Sequence; identical to SEQ ID NO: 26348
  neuraminidase__InfluenzaA__EPI227595

SEQ ID NO: 26373 - protein, 469 aa, Artificial Sequence
  neuraminidase__InfluenzaA__EPI569385
MNPNQKIITIGSVSLTIATVCFLMQIAILATTVTLHFKQNECSIPPNNQVVPCEPIIIEKNITEIVYLNNTTIEKEVCPEVPEYRNWSKPQCQITGFAPFSKDNSIRLSAGGDIWVTREPYVSCSPGKCYQFALGQGTTLNNKHSNGTIHDRIPHRTLLMSELGVPFHLGTKQVCIAWSSSSCHDGKAWLHVCVTGDDRNATASFIYDGMLADSIGSWSQNILRTQESECVCINGTCTVVMTDGSASGRADTRILFIKEGKIVHISPLSGSAQHIEECSCYPRYPDVRCVCRDNWKGSNRPVIDINMADYSIDSSYVCSGLVGDTPRNDDSSSSSNCRDPNNERGNPGVKGWAFDNGNDVWMGRTISEDSRSGYETFRVTDGWTTANSKSQVNRQIIVDNNNWSGYSGIFSVEGKSCINRCFYVELIRGRPQETRVWWTSNSIVVFCGTSGTYGTGSWPDGANINFMPI

SEQ ID NO: 26374 - protein, 459 aa, Artificial Sequence
  neuraminidase__InfluenzaA__EPI736916
MNPNQKITCISATGVTLSVVSLLIGIANLGLNIGLHYKVSDSTTISIPNMNETNPTTTNITNIIVNKNEERTFLNLTKPLCEVNSWHILSKDNAIRIGEDAHILVTREPYLSCDPQGCRMFALSQGTTLRGRHANGTIHDRSPFRALISWEMGQAPSPYNTRVECIGWSSTSCHDGISRMSICISGPNNNASAVVWYRGRPVTEIPSWAGNILRTQESECVCHKGICPVVMTDGPANNKAATKIIYFKEGKVQKIEELQGNAQHIEECSCYGAAGMIKCVCRDNWKGANRPIITIDPEMMTHTSKYLCSKILTDTSRPNDPTNGNCDAPITGGSPDPGVKGFAFLDGENSWLGRTISKDSRSGYEMLKVPNAETDTQSGPTSYQLIVNNQNWSGYSGAFIDYWANKECFNPCFYVELIRGRPKESDVLWTSNSMVALCGSRERLGSWSWHDGAEIIYFK

SEQ ID NO: 26375 - protein, 459 aa, Artificial Sequence; identical to SEQ ID NO: 25994
  neuraminidase__InfluenzaA__EPI593891

SEQ ID NO: 26376 - protein, 459 aa, Artificial Sequence
  neuraminidase__InfluenzaA__EPI691380
MNPNQKIVCISVTGVTLSVVSLLIGITNLGLNIGLHYKVSDSTTINIPNMNETNPTTTNITNIIMNKNEERTFLKLTKPLCEVNSWHILSKDNAIRIGEDAHILVTREPYLSCDPQGCRMFALSQGTTLRGQHANGTIHDRSPFRALISWEMGQAPSPYNTRVECIGWSSTSCHDGISRMSICISGPNNNASAVVWYRGRPVTEIPSWAGNILRTQESECVCHKGICPVVMTDGPANNKAATKIIYFKEGKIQKTEELQGNAQHIEECSCYGAAGMIKCVCRDNWKGANRPIITIDPEMMTHTSKYLCSKILTDTSRPNDPTNGNCDAPITGGSPDPGVKGFAFLDGENSWLGRTISKDSRSGYEMLKVPNAEIDIQSGPISYQLVVNNQNWSGYSGAFIDYWANKECFNPCFYVELIRGRPKESGVLWTSNSMVALCGSRERLGSWSWHDGAEIIYFK

SEQ ID NO: 26377 - protein, 470 aa, Artificial Sequence
  neuraminidase__InfluenzaA__EPI533584
MNPNQKITCISATGMTLSVVSMLIGIANLGLNIGLHYKVSDSTNINIPNMNETSPTTTIINNHPQNNFTNITNIIVTKNEEGHLLNLTKPLCEVNSWHILSKDNAIRIGEDAHIIVTREPYLSCDPQGCRMFALSQGTTLRGKHANGTIHDRSPFRALVSWEMGQAPSPYNTRVECIGWSSTSCHDGISRMSICISGPNNNASAVVWYGGRPVTEIPSWAGNILRTQESECVCHGGICPVVMTDGPANNRAETKIIYFKEGKIKKIEELKGDAQHIEECSCYGASEMIKCICRDNWKGANRPVITIDPEMMTHTSKYLCSKILTDTSRPNDPTNGKCEAPITGGSPDPGVKGFAFLDGENSWLGRTISKDSRSGYEMLKVPNAETDTQSGAISHQIIVNNQNWSGYSGAFIDYWANKECFNPCFYVELIRGRPKESSVLWTSNSIVALCGSKERLGSWSWHDGAEIIYFK

SEQ ID NO: 26378 - protein, 459 aa, Artificial Sequence; identical to SEQ ID NO: 25998
  neuraminidase__InfluenzaA__EPI641400

SEQ ID NO: 26379 - protein, 459 aa, Artificial Sequence; identical to SEQ ID NO: 25998
  neuraminidase__InfluenzaA__EPI587620

SEQ ID NO: 26380 - protein, 469 aa, Artificial Sequence
  neuraminidase__InfluenzaA__EPI569392
MNPNQKIVTIGSLSLGLVVFNVLLHAVSIILTVLALGKSENNGICNGTVVREYNETVRIEKVTQWYNTSVVEYVPHWNEGTYINNTEPICDVKGFAPFSKDNGIRVGSRGHIFVIREPFVSCSPVGCRTFFLTQGSLLNDKHSNGTVKDRSPFRTLMSVEVGQSPNVYQARFEAVAWSATACHDGKKWMAIGVTGPDSKAVAVVHYGGVPTDVVNSWAGDILRTQESSCTCIQGNCYWVMTDGPANRQAQYRIYKANQGKIIGRKDVSFSGGHIEECSCYPNDGKVECVCRDNWTGTNRPVLIISPDLSYRVGYLCAGLPSDTPRGEDTQFVGSCTSPMGNQGYGVKGFGFRQGTDVWVGRTISRTSRSGFEIIRIKNGWTQTSKEQIRRQVVVDNSNWSGYSGSFTLPVELSGRECLVPCFWVEMIRGRPEERTIWTSSSSIVMCGVDYEIADWSWHDGAILPFDIDK

SEQ ID NO: 26381 - protein, 455 aa, Artificial Sequence
  neuraminidase__InfluenzaA__EPI459857
MNPNQKIITIGSICMVIGTVSLIVQVGNIILIWVNHSIQTCITYENNTWVNQTYVSNTNFLTGQAVASVTLAGNSSLCPISGWAIYSKDNGIRIGSKGDVFVIREPFISCSHLECRTFFLTQGALLNDKHSNGTIKDRSPYRTLMSCPVGEAPSPYNSRFESVAWSASACHDGINWLTIGISGPDNEAVAVLKYNGVITDTIKSWRNNILRTQESECACVNGSCFTVMTDGPSNGQASYKIFKIEKGKVVRSVELDAPNYHYEECSCYPDAGEITCVCRDNWHGSNRPWVSFNQNLEYQTGYICSGVFGDSPRPNDGTGSCGPVSSNGAFGVKGFSFKYGNGVWIGRTKTTNSRSGFEMIWDPNGWTETDSSFSMKQDIIAITDWSGYSGSFVQHPELTGLNCMRPCFWVELIRGQPRENTIWTSGSSISFCGVNSETVGWSWPDGAELPFTIDK

SEQ ID NO: 26382 - protein, 471 aa, Artificial Sequence
  neuraminidase__InfluenzaA__EPI242204
MNPNQKLFALSGVAIALSVLNLLIGISNVGLNVSLHLKGEGVKQENNLTCTTITQNNTTVVENTYVNNTTIINKGTNLKAPNYLLLNKSLCSVEGWVVIAKDNAIRFGESEQIIVTREPYVSCDPSGCKMYALHQGTTIRNKHSNGTIHDRTTFRGLISTPLGTPPTVSNSDFICVGWSSTSCHDGVGRMTICIQGNNDNATATVYYNRRLTTTIKTWAKNILRTQESECVCHNGTCAVVMTDGPASSQAYTKIMYFHKGLIIKEEPLRGSARHIEECSCYGHDQKVSCVCRDNWQGANRPIIEIDMSTLEHTSRYVCTGVLTDTSRPGDKPNGDCSNPITGSPGAPGVKGFGFLNGDNTWLGRTISPRSRSGFEMLKIPNAETDPNSRIIERQEIVDNSNWSGYSGSFIDYWDEANECYNPCFYVELIRGRPEEAKYVWWTSNSLIALCGSPVSVGSGSFPDGAQIQYFS

SEQ ID NO: 26383 - protein, 471 aa, Artificial Sequence
  neuraminidase__InfluenzaA__EPI408029
MNPNQKLFALSGVAIALSVLNLLIGISNVGLNMSLHLKGEGVKQENNLTCTTITQNNTTVVENTYVNNTTIINKGTNLKAPNYLLLNKSLCSVEGWVVIAKDNAIRFGESEQIIVTREPYVSCDPSGCKMYALHQGTTIRNKHSNGTIHDRTTFRGLLSTPLGTPPTVSNSDFICVGWSSTSCHDGVGRMTICIQGNNDNATATVYYNRRLTTTIKTWAKNILRTQESECVCHNGTCAVVMTDGPASSQAYTKIMYFHKGLIIKEEPLRGSARHIEECSCYGHDQKVSCVCRDNWQGANRPIIEIDMSTLEHTSRYVCTGVLTDTSRPGDKPNGDCSNPITGSPGAPGVKGFGFLNGDNTWLGRTISPRSRSGFEMLKIPNAETDPNSRIIERQEIVDNSNRSGYSGSFIDYWDEANECYNPCFYVELIRGRPEEAKYVWWTSNSLIALCGSPVSVGSGSFPDGAQIQYFS

SEQ ID NO: 26384 - protein, 465 aa, Artificial Sequence; identical to SEQ ID NO: 23454
  neuraminidase__InfluenzaA__EPI439509

SEQ ID NO: 26385 - protein, 449 aa, Artificial Sequence; identical to SEQ ID NO: 25987
  neuraminidase__InfluenzaA__EPI164223

SEQ ID NO: 26386 - protein, 465 aa, Artificial Sequence; identical to SEQ ID NO: 23454
  neuraminidase__InfluenzaA__EPI486493

SEQ ID NO: 26387 - protein, 465 aa, Artificial Sequence
  neuraminidase__InfluenzaA__EPI740737
MNPNQKILCTSATAITISAIAVLIGIANLGLNIGLHLKPGCNCSHSQPETTNTSQTIINNYYNETNITNIQIEERTSRNFNNLTKGLCTINSWHIYGKDNAVRIGESSDVLVTREPYVSCDPDECRFYALSQGTTIRGKHSNGTIHDRSQYRALISWPLSSPPTVHNSRVECIGWSSTSCHDGKSRMSICISGPNNNASAVVWYNRRPVAEINTWARNILRTQESECVCHNGVCPVVFTDGPATGPADTRIYYFKEGKILKWESLTGTAKHIEECSCYGERTGITCTCRDNWQGSNRPVVQIDPVAMTHTSQYICSPVLTDSPRPNDPNIGKCNDPYPGNNNNGVKGFSYLDGANTWLGRTISTASRSGYEMLKVPNALTDDRSKPIQGQTIVLNADWSGYSGSFMDYWAEGDCYRACFYVELIRGRPKEDKVWWTSNSIVSMCSSTEFLGQWNWPDGAKIEYFL

SEQ ID NO: 26388 - protein, 465 aa, Artificial Sequence
  neuraminidase__InfluenzaA__EPI730494
MNPNQKILCTSATAITIGAIAVLIGIANLGLNIGLHLKPGCNCSHSQPEITNTSQTIINNYYSETNITNIQMEERTSKNFNNLTKGLCTINSWHIYGKDNAVRIGESSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKILKWESLTGTAKHIEECSCYGERTGITCTCRDNWQGSNRPVIQIDPVAMTHTSQYICSPVLTDNPRPNDPNIGKCNDPYPGNNNNGIKGFSYLDGANTWLGRTISTASRSGYEMLKVPNALTDDRSKPIQGQTIVLNADWSGYSGSFMDYWAEGDCYRACFYVELIRGRPKEDKVWWTSNSIVSMCSSTEFLGQWNWPDGAKIEYFL

SEQ ID NO: 26389 - protein, 465 aa, Artificial Sequence
  neuraminidase__InfluenzaA__EPI712925
MNPNQKILCTSATAITIGAIAVLIGIANLGLNIGLHLKPGCNCSHSQPETTNTSQTIINNYYNETNITNIQIEERTSRNFNNLTKGLCTINSWHIYGKDNAVRIGESSDVLVTREPYVSCDPDECRFYALSQGTTIRGKHSNGTIHDRSQYRALISWPLSSPPTVHNSRVECIGWSSTSCHDGKSRMSICISGPNNNASAVVWYNRRPVAEINTWARNILRTQESECVCHNGVCPVVFTDGPATGPADTRIYYFKEGKILKWESLTGTAKHIEECSCYGERTGITCTCRDNWQGSNRPVVQIDPVAMTHTSQYICSPVLTDSPRPNDPNIGKCNDPYPGNNNNGVKGFSYLDGANTWLGRTISTASRSGYEMLKVPNALTDDRSKPIQGQTIVLNADWSGYSGSFMDYWAEGDCYRACFYVELIRGRPKEDKVWWTSNSIVSMCSSTEFLGQWNWPDGAKIEYFL

SEQ ID NO: 26390 - protein, 465 aa, Artificial Sequence
  neuraminidase__InfluenzaA__EPI448938
MNPNQKILCTSATAIIIGAIAVLIGMANLGLNIGLHLKPGCNCSHSQPETTNTSQTIINNYYNETNITNIQMEERTSRNFNNLTKGLCTINSWHIYGKDNAVRIGESSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKILKWESLTGTAKHIEECSCYGERTGITCTCRDNWQGSNRPVIQIDPVAMTHTSQYICSPVLTDNPRPNDPNIGKCNDPYPGNNNNGVKGFSYLDGANTWLGRTISTASRSGYEMLKVPNALTDDRSKPIQGQTIVLNADWSGYSGSFMDYWAEGDCYRACFYVELIRGRPKEDKVWWTSNSIVSMCSSTEFLGQWNWPDGAKIEYFL

SEQ ID NO: 26391 - protein, 469 aa, Artificial Sequence
  neuraminidase__InfluenzaA__EPI445995
MNPNQKIIALGSASLTIAIICLLIQIAILATTMTLHFMQNEHTNSTRNKVVPCESIIIERNITEIVHLNGTIIEKESCPKAVEYKNWSKPQCQITGFAPFSKDNSIRLSAGGDIWVTREPYVSCSLSKCYQFALGQGTTLNNRHSNGTTHDRSPYRTLLMSELGVPFHLGTKQVCIAWSSSSCHDGRAWLHVCVTGDDKNATASVIYGGMLTDSIGSWSKNILRTQESECVCINGTCTVVMTDGSASGRADTRILFIREGKIVHISPLSGSAQHVEECSCYPRYPEVRCVCRDNWKGSNRPVLYINVADYSIDSSYVCSGLVGDTPRNEDSSSSSNCRDPNNERGGPGVKGWAFDNGDDVWMGRTIKKDSRAGYETFRVVDGWTLANSKSQTNRQVIVDSDNWSGYSGMFSVEGKTCINRCFYVELIRGRPQETRVWWTSNSIIVFCGTSGTYGTGSWPDGADINFMSI

SEQ ID NO: 26392 - protein, 469 aa, Artificial Sequence
  neuraminidase__InfluenzaA__EPI470861
MNPNQKIIAIGSVSLTIATICLLMQIAILATTMTLHFKQNECINSSNNQVVPCEPIIIERNITEIVHLNSTTLEKEICPKVADYRNWSKPQCQITGFAPFSKDNSIRLSAGGDIWVTREPYVSCGLGKCYQFALGQGTTLENKHSNGTAHDRTPHRTLLMNELGVPFHLATKQVCIAWSSSSCHDGKAWLHVCVTGDDRNATASIIYDGILVDSIGSWSKNILRTQESECVCINGTCAVVMTDGSASGRADTRILFIREGKIAHISPLSGSAQHVEECSCYPRYPEVRCVCRDNWKGSNRPVLYINMANYSIDSSYVCSGLVGDTPRNDDRSSSSNCRDPNNERGAPGVKGWAFDNGNDIWMGRTIKKDSRSGYETFRVIGGWTTANSKSQINRQVIVDSDNSSGYSGIFSVEGKSCINRCFYVELIRGRPKETRVWWTSNSIIVFCGTSGTYGTGSWPDGANINFMPI

SEQ ID NO: 26393 - protein, 466 aa, Artificial Sequence
  neuraminidase__InfluenzaA__EPI498036
MNPNQKIIAIGSVSLIIAIICLLMQIAILTTTMTLHFRQNECSNPSNNQVMPCEPIILERNTVHLNSTIIEREICPKVADYKNWSKPQCQITGFAPFSKDNSIRLSAGGDIWVTREPYVSCSLDKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRVLFIREGKIINISPLSGSAQHVEECSCYPRYPEVRCVCRDNWKGSNRPILYINMADYSIESSYVCSGLVGDTPRNDDSSSSSNCRDPNNERGAPGVKGWAFDDGNDVWMGRTIKNGSRSGYETFRVVNGWTMANSKSQINRQVIVDSDDWSGYSGIFSVEGKKCINRCFYVELIRGRPQEPRVWWTSNSIIVFCGTSGTYGTGSWPDGANINFMPV

SEQ ID NO: 26394 - protein, 469 aa, Artificial Sequence
  neuraminidase__InfluenzaA__EPI470902
MNPNQKIVAIGSASLTIATMCLLMQIALFATTMTLHFKQTGCTNSSDNQAVPCGPIIIERNITEIVHLNSTTLEKETCPKSAGYRNWSKPQCQITGFAPFSKDNSIRLAAAGDIWVTREPYVSCGLGKCYQFALGQGTTLDNKHSNGTTHDRTPHRTLLMNELGVPFHLATKQVCIAWSSSSCHDGKAWLHVCVTGDDKNATASIIYDGILVDSIASWSKNILRTQESECVCINGTCTVVMTDGSASGRADTRILFIREGKIVHISPLSGSAQHVEECSCYPRYPEVRCVCRDNWKGSNRPVLFINMADYSIDSSYVCSGLVGDTPRNDDRSSSSNCRDPNNERGAPGVKGWAFDSGNDIWMGRTIEKDSRSGYETFRVIGGWSTANSKSQINRQVIVDRDNSSGYSGIFSVEGKSCINRCFYVELIRGRPKENRVWWTSNSIIVFCGTSGTYGTGSWPDGANINLMPI

SEQ ID NO: 26395 - protein, 466 aa, Artificial Sequence
  neuraminidase__InfluenzaA__EPI838241
MNPNQKITAIGSVSLIIAIICLLMQIAILTTTMTLHFRQNECSNSSNNQVMPCEPIIIERNTVHLNSTTIEREICPKVAEYKNWSKPQCQITGFAPFSKDNSIRLSASGDIWVTREPYVSCSLDKCYQFALGQGTTLKNKHSNGTAHDRTPHRTLLMNELGVPFHLGTKQVCIAWSSSSCYDGKAWLHVCVTGDDKNATASIIYDGMLVDSIGSWSKNILRTQESECVCINGTCAVVMTDGSASGKADTRVLFIREGKIINISPLSGSAQHVEECSCYPRYPEVRCVCRDNWKGSNRPILYINMADYSIESSYVCSGLVGDTPRNDDSSSSSNCRDPNNERGAPGVKGWAFDDGNDVWMGRTIKNGSRSGYETFRVVNGWTMANSKSQINRQVIVESDDWSGYSGIFSVEGKKCINRCFYVELIRGRPQEPRVWWTSNSIIVFCGTSGTYGTGSWPDGANINFMPI

SEQ ID NO: 26396 - protein, 466 aa, Artificial Sequence; identical to SEQ ID NO: 26395
  neuraminidase__InfluenzaA__EPI680525

SEQ ID NO: 26397 - protein, 466 aa, Artificial Sequence; identical to SEQ ID NO: 26003
  neuraminidase__InfluenzaA__EPI690481

SEQ ID NO: 26398 - protein, 584 aa, Artificial Sequence
  hemagglutinin__InfluenzaB__ABL76276
MKAIIVLLMVVTSNADRICTGITSSNSPHVVKTATQGEVNVTGVIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTVEVPHICTKEEDQITVWGFHSDNKTQMKNLYGDSNPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26399 - protein, 584 aa, Artificial Sequence
  hemagglutinin__InfluenzaB__ABL76287
MKAIIVLLMVVTSNADRICTGITSSNSPHVVKTATQGEVNVTGVIPLTTTPTKSHFANLKGTKTRGKLCPTCLNCTDLDVALGRPMCVGVTPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTIEVPHICTKEEDQITVWGFHSDNKIQMKNLYGDSNPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26400 - protein, 584 aa, Artificial Sequence
  hemagglutinin__InfluenzaB__ABL76298
MKAIIVLLMVVTSNADRICTGITSSNSPHVVKTATQGEVNVTGVIPLTTTPTKSHFANLKGTKTRGKLCPTCLNCTDLDVALGRPMCVGVTPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTVEVPHICTKEEDQITVWGFHSDNKTQMKNLYGDSNPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26401 - protein, 584 aa, Artificial Sequence
  hemagglutinin__InfluenzaB__ABL76309
MKAIIVLLMVVTSNADRICTGITSSNSPHVVKTATQGEVNVTGVIPLTTTPTKSHFANLKGTKTRGKLCPTCLNCTDLDVALGRPMCVGVTPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTVEVPHICTKEEDQITVWGFHSDNKTQMKNLYGDSNPQKFTSSANGVTTHYVSQIGGFPDQTEDGGLPQSGRIVVDYMVQRPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAEEFSLPTFDSLNITAASLNDDGLDNHTILLYYSTAASSLAVTLMIAIFIVYMISRDNVSCSICL

SEQ ID NO: 26402 - protein, 584 aa, Artificial Sequence
  hemagglutinin__InfluenzaB__ABL76331
MKAIIVLLMVVTSNADRICTGITSSNSPHVVKTATQGEVNVTGVIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTIEVPHICTKEEDQITVWGFHSDNKTQMKNLYGDSNPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26403 - protein, 584 aa, Artificial Sequence
  hemagglutinin__InfluenzaB__ABL76342
MKAIIVLLMVVTSNADRICTGITSSNSPHVVKTATQGEVNVTGVIPLTTTPTKSHFANLKGTKTRGKLCPTCLNCTDLDVALGRPMCVGVTPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTVEVPHICTKEEDQITVWGFHSDNKTQMKNLYGDSNPQKFTSSANGVTTHYVSQIGDFPDQTEDGGLPQSGRIVVDYMVQKPGKTGTIVYQRGILLPQKVWCASGRSKVIRGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGDFSLPTFDSLNITAASLNDDGLDNHTILLYYSTAASSLAVTLMIAIFIVYMISRDNVSCSICL

SEQ ID NO: 26404 - protein, 584 aa, Artificial Sequence
  hemagglutinin__InfluenzaB__ABL76353
MKAIIVLLMVVTSNADRICTGITSSNSPHVVKTATQGEVNVTGVIPLTTTPTKSHFANLKGTKTRGKLCPTCLNCTDLDVALGRPMCVGVTPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTVEVPHICTKEEDQITVWGFHSDNKTQMKNLYGDSNPQKFTSSANGVTTHYVSQIGGFPDQTEDGGLPQSGRIVVDYMVQKPGKTGTIVYQRGILLPQKVWCASGRSKVIRGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGDFSLPTFDSLNITAASLNDDGLDNHTILLYYSTAASSLAVTLMIAIFIVYMISRDNVSCSICL

SEQ ID NO: 26405 - protein, 584 aa, Artificial Sequence
  hemagglutinin__InfluenzaB__ABL76375
MKAIIVLLMVVTSNADRICTGITSSNSPHVVKTATQGEVNVTGAIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAEKAPGGPYRLGTSGSCPNATSKSGFFATMAWAVPRDNNKTATNPLTVEVPHICTKEEDQITVWGFHSDNKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26406 - protein, 584 aa, Artificial Sequence; identical to SEQ ID NO: 26405
  hemagglutinin__InfluenzaB__ABL76386

SEQ ID NO: 26407 - protein, 584 aa, Artificial Sequence
  hemagglutinin__InfluenzaB__ABL76408
MKAIIVLLMVVTSNADRICTGITSSNSPHVVKTATQGEVNVTGAIPLTTTPTKSHFANLKGTKTRGKLCPTCFNCTDLDVALGRPMCVGITPSAKASILHEVRPVTSGCFPIMHDRTKIRQLPNLLRGYEKIRLSTQNVIDAEKAPGGPYRLGTSGSCPNATSKSGFFATMAWAVPRGNNKTATNPLTVEVPHICTKEEDQITVWGFHSDNKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26408 - protein, 584 aa, Artificial Sequence
  hemagglutinin__InfluenzaB__ABL76419
MKAIIVLLMVVTSNADRICTGITSSNSPHVVKTATQGEVNVTGAIPLTTTPTKSHFANLKGTKTRGKLCPTCFNCTDLDVALGRPMCVGITPSAKASILHEIRPVTSGCFPIMHDRTKIRQLPNLLRGYEKIRLSTQNVIDAEKAPGGPYRLGTSGSCPNATSKSGFFATMAWAVPRGNNKTATNPLTVEVPHICTKEEDQITVWGFHSDNKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26409 - protein, 585 aa, Artificial Sequence
  hemagglutinin__InfluenzaB__ABL76441
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKPGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDELDNHTILLYYSTAASSLAVTLMIAIFVVYMVSRDNVSCSICL

SEQ ID NO: 26410 - protein, 585 aa, Artificial Sequence
  hemagglutinin__InfluenzaB__ABL76463
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVNDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26411 - protein, 585 aa, Artificial Sequence
  hemagglutinin__InfluenzaB__ABL76474
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDELDNHTILLYYSTAASSLAVTLMIAIFVVYMVSRDNVSCSICL

SEQ ID NO: 26412 - protein, 585 aa, Artificial Sequence
  hemagglutinin__InfluenzaB__ABL76485
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFVTMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSENEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26413 - protein, 585 aa, Artificial Sequence
  hemagglutinin__InfluenzaB__ABL76507
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNEIQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26414 - protein, 585 aa, Artificial Sequence
  hemagglutinin__InfluenzaB__ABL76518
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNENQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26415 - protein, 585 aa, Artificial Sequence
  hemagglutinin__InfluenzaB__ABL76529
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFVTMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26416 - protein, 585 aa, Artificial Sequence
  hemagglutinin__InfluenzaB__ABL76540
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVKPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26417 - protein, 585 aa, Artificial Sequence
  hemagglutinin__InfluenzaB__ABL76551
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMMAIFVVYMVSRDNVSCSICL

SEQ ID NO: 26418 - protein, 585 aa, Artificial Sequence
  hemagglutinin__InfluenzaB__ABL76562
MKAIIVLLMVVTSNADRICTRITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDVGEFSLPTFDSLNITAASLNDDGLDNHTILLYYSTAASSLAVTLMIAIFVVYMVSRDNVSCSICL

SEQ ID NO: 26419 - protein, 585 aa, Artificial Sequence
  hemagglutinin__InfluenzaB__ABL76573
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26420 - protein, 585 aa, Artificial Sequence; identical to SEQ ID NO: 26419
  hemagglutinin__InfluenzaB__ABL76584

SEQ ID NO: 26421 - protein, 585 aa, Artificial Sequence; identical to SEQ ID NO: 26419
  hemagglutinin__InfluenzaB__ABL76595

SEQ ID NO: 26422 - protein, 585 aa, Artificial Sequence; identical to SEQ ID NO: 26419
  hemagglutinin__InfluenzaB__ABL76606

SEQ ID NO: 26423 - protein, 585 aa, Artificial Sequence
  hemagglutinin__InfluenzaB__ABL76617
MKAIIVLLMVVTSNADRICTGITSSNSPHVVKTATQGEVNVTGVIPLTTTPTKSHFANLKGTETRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26424 - protein, 584 aa, Artificial Sequence
  hemagglutinin__InfluenzaB__ABL76628
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPHICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26425 - protein, 584 aa, Artificial Sequence
  hemagglutinin__InfluenzaB__ABL76639
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKAGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26426 - protein, 584 aa, Artificial Sequence
  hemagglutinin__InfluenzaB__ABL76683
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26427 - protein, 583 aa, Artificial Sequence
  hemagglutinin__InfluenzaB__ABL76694
MKAIIVLLMVVTSNADRICTGITSSNSPHVVKTATQGEVNVTGVIPLTTTPTKSHFANLKGTKTRGKLCPNCLNCTDLDVALGRPMCVGTTPSAKASILHEVRPVTSGCFPIMHDRTKIRQLPNLLRGYENIRLSTQNVINAERAPGGPYRLGTSGSCPNVTSRDGFFATMAWAVPRDNKTATNPLTVEVPYICTKGEDQITVWGFHSDNKTQMKNLYGDSNPQKFTSSANGVTTHYVSQIGGFPNQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26428 - protein, 585 aa, Artificial Sequence
  hemagglutinin__InfluenzaB__ABL76716
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLVNGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26429 - protein, 584 aa, Artificial Sequence
  hemagglutinin__InfluenzaB__ABL76760
MKAIIVLLMVVTSNADRICTGITSSNSPHVVKTATQGEVNVTGVIPLTTTPTKSHFANLKGTKTRGKLCPTCLNCTDLDVALGRPMCVGVTPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTIEVPHICTKEEDQITVWGFHSDNKTQMKNLYGDSNPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFDAGEFSLPTFDSLNITAASLNDDGLDNHTILLYYSTAASSLAVTLMIAIFIVYMISRDNVSCSICL

SEQ ID NO: 26430 - protein, 584 aa, Artificial Sequence
  hemagglutinin__InfluenzaB__ABL76771
MKAIIVLLMVVTSNADRICTGITSSNSPHVVKTATQGEVNVTGVIPLTTTPTKSHFANLKGTKTRGKLCPTCLNCTDLDVALGRPMCVGVTPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTIEVPHICTKEEDQITVWGFHSDDKTQMKNLYGDSNPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKILGPSAVDIGNGCFETKHKCNQTCLDRIAAGTFDAGEFSLPTFDSLNITAASLNDDGLDNHTILLYYSTAASSLAVTLMIAIFIVYMISRDNVSCSICL

SEQ ID NO: 26431 - protein, 584 aa, Artificial Sequence
  hemagglutinin__InfluenzaB__ABL76782
MKAIIVLLMVVTSNADRICTGITSSNSPHVVKTATQGEVNVTGVIPLTTTPTKSHFANLKGTKTRGKLCPTCLNCTDLDVALGSPMCVGITPSAKASILHEVRPVTSGCFPIMHDRTKIRQLPNLLRGYEKIRLSTQNVINIEKAPGGPYRLGTSGSCPNATSRSGFFATMAWAVPRDNNKTATNPLTVEVPHICTKEEDQITVWGFHSDNKAQMKNLYGDSNPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26432 - protein, 584 aa, Artificial Sequence; identical to SEQ ID NO: 26405
  hemagglutinin__InfluenzaB__ABL76793

SEQ ID NO: 26433 - protein, 584 aa, Artificial Sequence; identical to SEQ ID NO: 26405
  hemagglutinin__InfluenzaB__ABL76815

SEQ ID NO: 26434 - protein, 585 aa, Artificial Sequence
  hemagglutinin__InfluenzaB__ABL76826
MKAIIVLLMVVTSNADRICTGITSSNSPHVVKTATQGEVNVTGVIPLTTTPTKSHFANLKGTKTRGKLCPECLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26435 - protein, 585 aa, Artificial Sequence
  hemagglutinin__InfluenzaB__ABL76837
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKVRQLPNLLRGYEHIRLSTHNVINAEKAPGGPYKIGTSGSCPNVTNGNGFFATMAWAVPKNDNNKTATNSLTVEVPYICTEGEDQITVWGFHSDSETQMAKLYGDSKPQKFTSSSNGVTTHYVSQIGGFPNQTEDGGLPQSGRIVVDYMVQKSGKTGTITYQRGILLPQKVWCASGRSKVIKGSLPLIGEADCLHERYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26436 - protein, 584 aa, Artificial Sequence
  hemagglutinin__InfluenzaB__ABL76848
MKAIIVLLMVVTSNADRICTGITSSNSSHVVKTATQGEVNVTGAIPLTTTPTKSHFANLKGTKTRGKLCPTCLNCTDLDVALGRPMCVGITPPAKASILHEVRPVTSGCFPIMHDRTKIRQLPNLLRGYEKIRLSTQNVINAEKAPGGPYRLGTSGSCPNATSKSGFFATMAWAVPRDNNKTATNPLTVEVPHICTKEEDQITVWGFHSDNKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26437 - protein, 584 aa, Artificial Sequence; identical to SEQ ID NO: 26405
  hemagglutinin__InfluenzaB__ABL76859

SEQ ID NO: 26438 - protein, 584 aa, Artificial Sequence
  hemagglutinin__InfluenzaB__ABL76881
MKAIIVLLMVVTSNADRICTGITSSNSPHVVKTATQGEVNVTGVIPLTTTPTKSHFANLKGTRTRGKLCPDCLNCTDLDVALGRPMCVGTTPSAKASILHEVRPVTSGCFPIMHDRTKIRQLPNLLRGYENIRLSTQNVIDAEKASGGPYRLGTSGSCPNATSKSGFFATMAWAVPKDNNKNATNPLTVEVPYICTEGEDQITVWGFHSDNETQMKNLYGDSNPQKFTSSANGVTTHYVSQIGGFPDQKEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26439 - protein, 584 aa, Artificial Sequence
  hemagglutinin__InfluenzaB__ABL76892
MKAIIVLLMVVTSNADRICTGITSSNSPHVVKTATQGEVNVTGVIPLTTTPTKSHFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYVCTEGEDQITVWGFHSDNKTQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26440 - protein, 584 aa, Artificial Sequence
  hemagglutinin__InfluenzaB__ABL76903
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQSVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGGFPDQTEDGGLPQSGRIVVDYMIQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISAQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26441 - protein, 585 aa, Artificial Sequence
  hemagglutinin__InfluenzaB__ABL76914
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNEAQMAKLYGDSKPQKFTSSSNGVTTHYVSQIGGFPNQTEDGGLPQSGRIVVDYMVQKSGKTGTITYQRGILLPQKVWCASGRSKVIKGSLPLIGEADCLHERYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26442 - protein, 584 aa, Artificial Sequence
  hemagglutinin__InfluenzaB__ABL76936
MKAIIVLLMVVTSNADRICTGITSSNSPHVVKTATQGEVNVTGVIPLTTTPTKSHFANLKGTKTRGKLCPTCLNCTDLDVALGRPMCVGTTPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTVEVPYICTKEEDQITVWGFHSDDKTQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26443 - protein, 584 aa, Artificial Sequence
  hemagglutinin__InfluenzaB__ABL76947
MKAIIVLLMVVTSNADRICTGITSSNSPHVVKTATQGEVNVTGAIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTVEVPHICTKEEDQITVWGFHSDDKTQMKNLYGDSNPQKFTSSTNGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26444 - protein, 585 aa, Artificial Sequence
  hemagglutinin__InfluenzaB__ABL76958
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMIAIFVVYMVSRDNISCSICL

SEQ ID NO: 26445 - protein, 585 aa, Artificial Sequence
  hemagglutinin__InfluenzaB__ABL76969
MKAIIVLLMVVTSNADRICTGITSSNSPHVVKTATQGEVNVTGVIPLTTTPTKSHFANLKGTRTRGKLCPKCLNCTDLDVALGRPKCTGNIPSAKVSILHEVRPVTSGCFPIMHDRTKIRQLPNLLRGYEHIRLSIHNVINAEKAPGGPYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26446 - protein, 584 aa, Artificial Sequence
  hemagglutinin__InfluenzaB__ABL76980
MKAIIVLLMVVTSNADRICTGITSSNSPHVVKTATQGEVNVTGVIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAEKAPGGPYRLGTSGSCPNATSKSGFFATMAWAVPRDNNKTATNPLTVEVPYICTKEEDQITVWGFHSDNKTQMKNLYGDSDPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26447 - protein, 583 aa, Artificial Sequence
  hemagglutinin__InfluenzaB__ABL76991
MKAIIVLLMVVTSNADRICTGITSSNSPHVVKTATQGEVNVTGVIPLTTTPTKSHFANLKGTKTRGKLCPNCLNCTDLDVALGRPMCIGITPSAKASILHEVRPVTSGCFPIMHDRTKIRQLPNLLRGYEHIRLSTHNVINAERAPGGPYRLGTSGSCPNVTSRSGFFATMAWAVPRDNKTATNPLTVEVPYICTKGEDQITVWGFHSDNKIQMKNLYGDSNPQKFTSSANGITTHYVSQIGGFPNQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKEKGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26448 - protein, 584 aa, Artificial Sequence
  hemagglutinin__InfluenzaB__ABL77002
MKAIIVLLMVVTSNADRICTGITSSNSPHVVKTATQGEVNVTGVIPLTTTPTKSHFANLKGTKTRGKLCPTCLNCTDLDVALGRPMCVGVTPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTIEVPHICTKEEDQITIWGFHSDDKTQMKNLYGDSNPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFDAGEFSLPTFDSLNITAASLNDDGLDNHTILLYYSTAASSLAVTLMIAIFIVYMISRDNVSCSICL

SEQ ID NO: 26449 - protein, 584 aa, Artificial Sequence
  hemagglutinin__InfluenzaB__ABL77013
MKAIIVLLMVVTSNADRICTGITSSNSPHVVKTATQGEVNVTGVIPLTTTPTKSYFANLKGTKTRGKLCPTCLNCTDLDVALGRPMCVGITPSAKASILHEVRPVTSGCFPIMHDRTKIRQLPNLLRGYEKIRLSTQNVINAEKAPGGPYRLGTSGSCPNATSKSGFFATMAWAVPRDNNKTATNPLTVEVPYICTKEEDQITVWGFHSDNKNQMKNLYGDSDPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26450 - protein, 584 aa, Artificial Sequence
  hemagglutinin__InfluenzaB__ABL77024
MKAIIVLLMVVTSNADRICTGITSSNSPHVVKTATQGEVNVTGAIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAEKAPGGPYRLGTSGSCPNATSKSGFFATMAWAVPRDNNKTATNPLTVEVPHICTKEEDQITVWGFHSDDKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26451 - protein, 584 aa, Artificial Sequence
  hemagglutinin__InfluenzaB__ABL77035
MKAIIVLLMVVTSNADRICTGITSSNSPHVVKTATQGEVNVTGAIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTVEVPHICTKEEDQITVWGFHSDDKTQMKNLYGDSNPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26452 - protein, 584 aa, Artificial Sequence
  hemagglutinin__InfluenzaB__ABL77046
MKAIIVLLMVVTSNADRICTGITSSNSPHVVKTATQGEVNVTGAIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAEKAPGGPYRLGTSGSCPNATSKSGFFATMAWAVPRDNNKTATNPLTVEVPHICTKEEDQITVWGFHSDDKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAIDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26453 - protein, 584 aa, Artificial Sequence
  hemagglutinin__InfluenzaB__ABL77057
MKAIIVLLMVVTSKADRICTGITSSNSPHVVKTATQGEVNVTGAIPLTTTPTKSHFANLKGTKTRGKLCPTCLNCTDLDVALGRPMCVGITPSAKASILHEVKPVTSGCFPIMHDRTKIRQLPNLLRGYEKIRLSTQNVINAEKAPGGPYRLGTSGSCPNATSKSGFFATMAWAVPRDNNKTATNPLTVEVPHICTKEEDQITVWGFHSDNKPQMKNLYGDSNPQKFTSSANGITTHYVSQIGGFPEQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26454 - protein, 585 aa, Artificial Sequence
  hemagglutinin__InfluenzaB__ABL77068
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYERIRLSNHNVINAEKAPGGPYKIGTSGSCPNVTNGNGFFATMAWAVPKNENNKTATNSLTIEVPYICTEGEDQITVWGFHSDNENQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMIAIFVVYMVSRDNVSCSICL

SEQ ID NO: 26455 - protein, 585 aa, Artificial Sequence
  hemagglutinin__InfluenzaB__ABL77090
MKAIIVLLMVVTSNADRICTGITSSNSPHVVKTATQGEVNVTGVIPLTTTLTKSHFANLKGTKTRGKLCPKCLNCTDLDVALGRPKCTGNIPSAKVSILHEVRPVTSGCFPIMHDRTKIRQLPNLLRGYERIRLSNHNVINAEKAPGGPYKIGTSGSCPNVTNGNGFFATMAWAVPKNENNKTATNSLTIEVPYICTEGEDQITVWGFHSDNEIQMVKLYGDSKPQKFTSSANGVTTHYVSQIGGFPNQIEDGGLPQSGRIVVDYMVQKSGKTGTITYQRGILLPQKVWCASGRSKIIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMIAIFVVYMVSRDNVSCSICL

SEQ ID NO: 26456 - protein, 584 aa, Artificial Sequence
  hemagglutinin__InfluenzaB__ABL77101
MKAIIVLLMVVTSKADRICTGITSSNSPHVVKTATQGEVNVTGAIPLTTTPTKSHFANLKGTKTRGKLCPTCLNCTDLDVALGRPMCVGITPSAKASILHEVKPVTSGCFPIMHDRTKIRQLPNLLRGYEKIRLSTQNVINAEKAPGGPYRLGTSGSCPNATSKSGFFATMAWAVPRDNNKTATNPLTVEVPHICTKEEDQITVWGFHSDDKTQMKNLYGDSNPQKFTSSANGITTHYVSQIGGFPEQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26457 - protein, 585 aa, Artificial Sequence
  hemagglutinin__InfluenzaB__ABL77134
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYERIRLSNHNVINAEKAPGGPYKIGTSGSCPNVTNGNGFFATMAWAVPKNENNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYATAASSLAVTLMIAIFVVYMVSRDNVSCSICL

SEQ ID NO: 26458 - protein, 585 aa, Artificial Sequence
  hemagglutinin__InfluenzaB__ABL77145
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYERIRLSNHNVINAEEAPGGPYKIGTSGSCPNVTNGNGFFATMAWAVPKNENNKTATNSLTIEVPYICTEGEDQITVWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMIAIFVVYMVSRDNVSCSICL

SEQ ID NO: 26459 - protein, 584 aa, Artificial Sequence
  hemagglutinin__InfluenzaB__ABL77156
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYVCTEGEDQITVWGFHSDDKTQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26460 - protein, 585 aa, Artificial Sequence
  hemagglutinin__InfluenzaB__ABL77178
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYERIRLSNHNVINAEKAPGGPYKIGTSGSCPNVTNGNGFFATMAWAVPKNENNKTATNSLTIEVPYICTEGEDQITVWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMIAIFVVYMVSRDNVSCSICL

SEQ ID NO: 26461 - protein, 584 aa, Artificial Sequence
  hemagglutinin__InfluenzaB__ABL77189
MKAIIVLLMVVTSNADRICTGITSSNSPHVVKTATQGEVNVTGVIPLTTTPTKSYFANLKGTRTRGKLCPDCLNCTDLDVALGIPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYVCTEGEDQITVWGFHSDNKIQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26462 - protein, 585 aa, Artificial Sequence
  hemagglutinin__InfluenzaB__ABL77200
MKAIIVLLMVVTSNADRICTGITSSNSPHVVKTATQGEVNVTGVIPLTTTPTKSHFANLKGTKTRGKLCPKCLNCTDLDVALGRPKCMGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKAGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDGKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26463 - protein, 584 aa, Artificial Sequence
  hemagglutinin__InfluenzaB__ABL77222
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDSKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26464 - protein, 585 aa, Artificial Sequence
  hemagglutinin__InfluenzaB__ABL77233
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDNEAQMAKLYGDSKPQKFTSSANGVTTHYVSQIGGFPNQTEDGGLPQSGRIVVDYMVQKSRKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26465 - protein, 585 aa, Artificial Sequence
  hemagglutinin__InfluenzaB__ABL77244
MKAIIVLLMVVTSNADRICTGITSSNSPHVVKTATQGEVNVTGVIPLTTTPTKSHFANLKGTKTRGKLCPKCLNCTDLDVALGRPKCTGTIPSAKASILHEVKPVTSGCFPIMHDRTKIRQLPNLLRGYEHIRLSTHNVINAETAPGGPYKVGTSGSCPNVTNGNGFFATMAWAVPKNDNNKTATNPLTVEVPYICTEGEDQITVWGFHSDNEAQMVKLYGDSKPQKFTSSANGVTTHYVSQIGGFPNQAEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKEKGFFGAIAGFLEGGWEGMIAGWHGYTSHGAHGVAVAADLKSTQEAINKITKNLNSLSELEVKNLQRLSGAMDELHNKILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26466 - protein, 583 aa, Artificial Sequence
  hemagglutinin__InfluenzaB__ABL77255
MKAIIVLLMVVTSNADRICTGITSSNSPHVVKTATQGEVNVTGVIPLTTTPTKSHFANLKGTKTRGKLCPNCLNCTDLDVALGRPMCMGTIPSAKASILHEVRPVTSGCFPIMHDRTKIRQLPNLLRGYENIRLSTHNVINAERAPGGPYRLGTSGSCPNVTSRNGFFATMAWAVPRDNKTATNPLTVEVPYICTKGEDQITVWGFHSDDKTQMKNLYGDSNPQKFTSSANGVTTHYVSQIGDFPNQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26467 - protein, 583 aa, Artificial Sequence
  hemagglutinin__InfluenzaB__ABL77266
MKAIIVLLMVVTSNADRICTGITSSNSPHVVKTATQGEVNVTGVIPLTTTPTKSHFANLKGTKTRGKLCPNCLNCTDLDVALGRPMCVGTTPSAKASILHEVRPVTSGCFPIMHDRTKIRQLPNLLRGYENIRLSTQNVINAERAPGGPYRLGTSGSCPNVTSRDGFFATMAWAVPRDNKTATNPLTVEVPYICTKGEDQITVWGFHSDSKTQMKNLYGDSNPQKFTSSANGVTTHYVSQIGGFPNQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26468 - protein, 583 aa, Artificial Sequence
  hemagglutinin__InfluenzaB__ABL77277
MKAIIVLLMVVTSNADRICTGITSSNSPHVVKTATQGEVNVTGVIPLTTTPTKSHFANLKGTKTRGKLCPNCLNCTDLDVALGRPMCVGNTPSAKASILHEVRPVTSGCFPIMHDRTKIRQLPNLLRGYENIRLSTQNVINAERAPGGPYRLGTSGSCPNVTNRDGFFATMAWAVPRDNKTATNPLTVEVPYICTKGEDQITVWGFHSDNKIQMKNLYGDSNPQKFTSSANGVTTHYVSQIGGFPNQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26469 - protein, 583 aa, Artificial Sequence
  hemagglutinin__InfluenzaB__ABL77288
MKAIIVLLMVVTSNADRICTGITSSNSPHVVKTATQGEVNVTGVIPLTTTPTKSHFANLKGTKTRGKLCPNCLNCTDLDVALGRPMCVGTTPSAKASILHEVRPVTSGCFPIMHDRTKIRQLPNLLRGYEHIRLSTQNVINAEKAPGGPYKLGTSGSCPNATSRSGFFATMAWAVPRDNKTATNPLTVEVPYICTKGEDQITVWGFHSDTKTQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26470 - protein, 583 aa, Artificial Sequence
  hemagglutinin__InfluenzaB__ABL77299
MKAIIVLLMVVTSNADRICTGITSSNSPHVVKTATQGEVNVTGVIPLTTTPTKSHFANLKGTKTRGKLCPNCLNCTDLDVALGRPMCIGNIPSAKASILHEVRPVTSGCFPIMHDRTKIRQLPNLLRGYEHIRLSTHNVINAERAPGGPYRLGTSGSCPNVTSRSGFFATMAWAVPRDNKTATNPLTVEVPYICTKGEDQITVWGFHSDNETQMKNLYGDSNPQKFTSSANGITTHYVSQIGGFPNQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26471 - protein, 583 aa, Artificial Sequence
  hemagglutinin__InfluenzaB__ABL77310
MKAIIVLLMVVTSNADRICTGITSSNSPHVVKTATQGEVNVTGVIPLTTTPTKSHFANLKGTKTRGKLCPNCLNCTDLDVALGRPMCIGTIPSAKASILHEVRPVTSGCFPIMHDRTKIRQLPNLLRGYEHIRLSTHNVINAERAPGGPYRLGTSGSCPNVTSRSGFFATMAWAVPRDNKTATNPLTVEVPYICTKGEDQITVWGFHSDNKNQMKNLYGDSNPQKFTSSANGVTTHYVSQIGGFPNQTEDGGLPQSGRIVVDYMVQKPGKTGTIVYQRGVLLPQKVWCVSGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26472 - protein, 585 aa, Artificial Sequence
  hemagglutinin__InfluenzaB__ABL77321
MKAIIVLLMVVTSNADRICTGITSSNSPHVVKTATQGEVNVTGVIPLTTTPTKSHFANLKGTKTRGKLCPKCLNCTDLDVALGRPKCTGTIPSAKVSILHEVKPVTSGCFPIMHDRTKIRQLPNLLRGYEHIRLSTHNVINAEKAPGGPYKIGTSGSCPNITNGNGFFATMAWAVPKNDNNKTATNSLTVEVPYICTEGEDQITVWGFHSDNETQMAKLYGDSKPQKFTSSANGVTTHYVSQIGGFPNQAEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLNLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26473 - protein, 584 aa, Artificial Sequence
  hemagglutinin__InfluenzaB__ABL77332
MKAIIVLLMVVTSNADRICTGITSSNSPHVVKTATQGEVNVTGVIPLTTTPTKSHFANLKGTKTRGKLCPNCLNCTDLDVALGRPMCVGTTPSAKASILHEVRPVTSGCFPIMHDRTKIRQLPNLLRGYENIRLSTQNVINAEKAPGGPYKLGTSGSCPNATSRSGFFATMAWAVPRDNNKTATNPLTVEVPYICTKGEDQITVWGFHSDDKTQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHAILLYYSTAASSLAVTLMIAIFIVYMVSRDNVSCSICL

SEQ ID NO: 26474 - protein, 584 aa, Artificial Sequence
  hemagglutinin__InfluenzaB__ABL77343
MKAIIVLLMVVTSNADRICTGITSSNSPHVVKTATQGEVNVTGVIPLTTTPTKSHFANLKGTKTRGKLCPNCLNCTDLDVALGRPMCVGTTPSAKASILHEVRPVTSGCFPIMHDRTKIRQLPNLLRGYENIRLSTQNVINAEKAPGGPYRLGTSGSCPNATSRSGFFATMAWAVPRDNNKTATNPLTVEVPYICTKGEDQITVWGFHSDNKIQMKNLYGDSNPQKFTSSANGVTTHYVSQIGGFPDQTEDGGLPQSGRIVVDYMVQKPGKTGTIVYQRGVLLPQKVWCASGRSKVVKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26475 - protein, 584 aa, Artificial Sequence
  hemagglutinin__InfluenzaB__ABL77365
MKAIIVLLMVVTSNADRICTGITSSNSPHVVKTATQGEVNVTGVIPLTTTPTKSHFANLKGTKTRGKLCPNCLNCTDLDVALGRPMCVGTTPSAKASILHEVRPVTSGCFPIMHDRTKIRQLPNLLRGYENIRLSTQNVINAEKAPGGPYRLGTSGSCPNATSRSGFFATMAWAVPRDNNKTATNPLTVEVPYVCTEGEDQITVWGFHSDNKTQMKNLYGDSNPQKFTSSANGVTTHYVSQIGGFPDQAEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26476 - protein, 584 aa, Artificial Sequence
  hemagglutinin__InfluenzaB__ABL84340
MKAIIVLLMVVTSNADRICTGITSSNSPHVVKTATQGEVNVTGVIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAEKAPGGPYRLGTSGSCPNTTSKSGFFATMAWAVPRDNNKTATNPLTVEVPHICTKEEDQITVWGFHSDNKTQMKNLYGDSNPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNGDGLDNHTILLYYSTAASSLAVTLMIAIFIVYMISRDNVSCSICL

SEQ ID NO: 26477 - protein, 584 aa, Artificial Sequence; identical to SEQ ID NO: 26398
  hemagglutinin__InfluenzaB__ABN50382

SEQ ID NO: 26478 - protein, 584 aa, Artificial Sequence; identical to SEQ ID NO: 26398
  hemagglutinin__InfluenzaB__ABN50393

SEQ ID NO: 26479 - protein, 584 aa, Artificial Sequence
  hemagglutinin__InfluenzaB__ABN50404
MKAIIVLLMVVTSNADRICTGITSSNSPHVVKTATQGEVNVTGVIPLTTTPTKSHFANLKGTKTRGKLCPTCLNCTDLDVALGRPMCVGVTPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTVEVPHICTKEEDQITVWGFHSDNKTQMKNLYGDSNPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26480 - protein, 584 aa, Artificial Sequence; identical to SEQ ID NO: 26407
  hemagglutinin__InfluenzaB__ABN50415

SEQ ID NO: 26481 - protein, 584 aa, Artificial Sequence; identical to SEQ ID NO: 26407
  hemagglutinin__InfluenzaB__ABN50426

SEQ ID NO: 26482 - protein, 584 aa, Artificial Sequence
  hemagglutinin__InfluenzaB__ABN50437
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDPNPQKFTSSANGVTTHYVSQIGGFPDQTEDGGLPQSGRIVVDYMMQKPGKTGTIVYQRGVLLPQKVWCASGKSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26483 - protein, 585 aa, Artificial Sequence
  hemagglutinin__InfluenzaB__ABN50459
MKALIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDNEIQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26484 - protein, 585 aa, Artificial Sequence
  hemagglutinin__InfluenzaB__ABN50470
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYERIRLSNHNVINAEKAPGGPYKIGTSGSCPNVTNGNGFFATMAWAVPKNENNKTATNSLTIEVPYICTEGEDQITVWGFHSDNEIQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMIAIFVVYMVSRDNVSCSICL

SEQ ID NO: 26485 - protein, 584 aa, Artificial Sequence
  hemagglutinin__InfluenzaB__ABN50481
MKAIIVLLLVVTSNADRICTGITSSNSPHVVKTATQGEVNVTGAIPLTTTPTKSHFANLKGTKTRGKLCPTCFNCTDLDVALGRPMCVGITPSAKASILHEVRPVTSGCFPIMHDRTKIRQLPNLLRGYEKIRLSTQNVIDAEKAPGGPYRLGTSGSCPNATSKSGFFATMAWAVPRDNNKTATNPLTVEVPHICTKEEDQITVWGFHSDNKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26486 - protein, 584 aa, Artificial Sequence
  hemagglutinin__InfluenzaB__ABN50503
MKAIIVLLMVVTSNADRICTGITSSNSPHVVKTATQGEVNVTGVIPLTTTPTKSHFANLKGTKTRGKLCPTCLNCTDLDVALGRPMCVGVTPSAKASILHEVRPVTSGCFPIMHDRTKIRQLPNLLRGYEKIRLSTQNVINAEKAPGGPYRLGTSGSCPNATSRSGFFATMAWAVPKDNNKTATNPLTVEVPHICTKEEDQITVWGFHSDDKTQMKNLYGDSNPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26487 - protein, 584 aa, Artificial Sequence
  hemagglutinin__InfluenzaB__ABN50514
MKAIIVLLMVATSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYVCTEGEDQITVWGFHSDNKPQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHDEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26488 - protein, 584 aa, Artificial Sequence
  hemagglutinin__InfluenzaB__ABN50525
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFSTMAWAVPKDNNKNATNPLTVEVPYVCTEGEDQITVWGFHSDNKTQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26489 - protein, 585 aa, Artificial Sequence
  hemagglutinin__InfluenzaB__ABN50536
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYERIRLSNHNVINAEEAPGGPYKIGTSGSCPNVTNGNGFFATMAWAVPKNENNKTATNSLTIEVPYICTEGEDQITVWGFHSDNEIQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMIAIFVVYMVSRDNVSCSICL

SEQ ID NO: 26490 - protein, 585 aa, Artificial Sequence
  hemagglutinin__InfluenzaB__ABN50547
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQLTVWGFHSDNENQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26491 - protein, 585 aa, Artificial Sequence
  hemagglutinin__InfluenzaB__ABN50558
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDKETQMAKLYGDSKPQKFTSSANGVTTHYVSQIGGFPNQTEDGGLPQSGRIVVDYMMQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26492 - protein, 584 aa, Artificial Sequence; identical to SEQ ID NO: 26407
  hemagglutinin__InfluenzaB__ABN50569

SEQ ID NO: 26493 - protein, 585 aa, Artificial Sequence; identical to SEQ ID NO: 26419
  hemagglutinin__InfluenzaB__ABN50580

SEQ ID NO: 26494 - protein, 585 aa, Artificial Sequence
  hemagglutinin__InfluenzaB__ABN50591
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYERIRLSNHNVINAEKAPGGPYKIGTSGSCPNVTNGNGFFATMAWAVPKNENNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMIAIFVVYMVSRDNVSCSICL

SEQ ID NO: 26495 - protein, 585 aa, Artificial Sequence
  hemagglutinin__InfluenzaB__ABN50602
MKAIIVLLMVVTSNADRICTGITSSNSPHVVKTATQGEVNVTGVIPLTTTPTKSHFANLKGTKTRGKLCPKCLNCTDLDVALGRPKCMGTIPSAKASILHEVKPVTSGCFPIMHDRTKIRQLPNLLRGYENIRLSTHNVINAETAPGGPYKIGTSGSCPNITNGNGFFATMAWAVPKNDNNKTATNPLTVEVPYICTEGEDQITVWGFHSDNETQMVKLYGDSKPQKFTSSANGVTAHYVSQIGGFPNQAEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26496 - protein, 583 aa, Artificial Sequence
  hemagglutinin__InfluenzaB__ABN50624
MKAIIVLLMVVTSNADRICTGITSSNSPHVVKTATQGEVNVTGVIPLTTTPTKSHFANLKGTKTRGKLCPNCLNCTDLDVALGRPMCIGTIPSAKASILHEVRPVTSGCFPIMHDRTKIRQLPNLLRGYENIRLSTHNVINAERAPGGPYRLGTSGSCPNVTSKSGFFATMAWAVPRDNKTATNPLTVEVPYICTKGEDQITVWGFHSDNKNQMKNLYGDSNPQKFTSSVNGVTTHYVSQIGGFPNQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26497 - protein, 583 aa, Artificial Sequence
  hemagglutinin__InfluenzaB__ABN50635
MKAIIVLLMVVTSNADRICTGITSSNSPHVVKTATQGEVNVTGVIPLTTTPTKSHFANLKGTKTRGKLCPNCLNCTDLDVALGRPMCIGTIPSAKASILHEVRPVTSGCFPIMHDRTKIRQLPNLLRGYEHIRLSTHNVINAERAPGGPYRLGTSGSCPNVTSRSGFFATMAWAVPRDNKTATNPLTVEVPYICTKGEDQITVWGFHSDSKTQMKNLYGDSNPQKFTSSANGVTTHYVSQIGGFPNQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26498 - protein, 583 aa, Artificial Sequence
  hemagglutinin__InfluenzaB__ABN50646
MKAIIVLLMVVTSNADRICTGITSSNSPHVVKTATQGEVNVTGVIPLTTTPTKSHFANLKGTKTRGKLCPNCLNCTDLDVALGRPMCIGTIPSAKASILHEVRPVTSGCFPIMHDRTKIRQLPNLLRGYEHIRLSTHNVINAERAPGGPYRLGTSGSCPNVTSRSGFFATMAWAVPRDNKTATNPLTVEVPYICTKGEDQITVWGFHSDNKNQMKNLYGDSNPQKFTSSANGVTTHYVSQIGGFPNQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26499 - protein, 583 aa, Artificial Sequence
  hemagglutinin__InfluenzaB__ABN50657
MKAIIVLLMVVTSNADRICTGITSSNSPHVVKTATQGEVNVTGVIPLTTTPTKSHFANLKGTKTRGKLCPNCLNCTDLDVALGRPMCVGITPSAKASILHEVRPVTSGCFPIMHDRTKIRQLPNLLRGYENIRLSTQNVINAEKAPGGPYRLGTSGSCPNVTSRTGFFATMAWAVPRDNKTATNPLTVEVPYICTKGEDQITVWGFHSDNKTQMKNLYGDSNPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26500 - protein, 584 aa, Artificial Sequence
  hemagglutinin__InfluenzaB__ABN50679
MKAIIVLLMVVTSNADRICTGITSSNSPHVVKTATQGEVNVTGVIPLTTTPTKSHFANLKGTKTRGKLCPNCLNCTDLDVALGRPMCVGTTPSAKASILHEVRPVTSGCFPIMHDRTKIRQLPNLLRGYENIRLSTQNVINAEKAPGGPYRLGTSGSCPNATSRSGFFATMAWAVPRDNNKTATNPLTVEVPYICTKGEDQITVWGFHSDDKTQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26501 - protein, 584 aa, Artificial Sequence
  hemagglutinin__InfluenzaB__ABN50690
MKAIIVLLMVVTSNADRICTGITSSNSPHVVKTATQGEVNVTGVIPLTTTPTKSHFANLKGTKTRGKLCPNCLNCTDLDVALGRPMCVGTTPSAKASILHEVRPVTSGCFPIMHDRTKIRQLPNLLRGYENIRLSTQNVINAEKAPGGPYRLGTSGSCPNATSRSGFFATMAWAVPRDNNKTATNPLTVEVPYVCTEGEDQITVWGFHSDNKTQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26502 - protein, 583 aa, Artificial Sequence
  hemagglutinin__InfluenzaB__ABN50701
MKAIIVLLMVVTSNADRICTGITSSNSPHVVKTATQGEVNVTGVIPLTTTPTKSHFANLKGTKTRGKLCPNCLNCTDLDVALGRPMCVGITPSAKASILHEVRPVTSGCFPIMHDRTKIRQLPNLLRGYENIRLSTQNVINAEKAPGGPYRLGTSGSCPNVTSRTGFFATMAWAVPRDNKTATNPLTVEVPYICTKGEDQITVWGFHSDNKAQMKNLYGDSNPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26503 - protein, 584 aa, Artificial Sequence; identical to SEQ ID NO: 26501
  hemagglutinin__InfluenzaB__ABN50712

SEQ ID NO: 26504 - protein, 584 aa, Artificial Sequence
  hemagglutinin__InfluenzaB__ABN50723
MKAIIVLLMVVTSNADRICTGITSSNSPHVVKTATQGEVNVTGVIPLTTTPTKSHFANLRGTKTRGKLCPTCLNCTDLDVALGRPMCVGTTPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTVEVPYICTKEEDQITVWGFHSDNKTQMKNLYGDSNPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26505 - protein, 584 aa, Artificial Sequence
  hemagglutinin__InfluenzaB__ABN50734
MKAIIVLLMVVTSNADRICTGITSSNSPHVVKTATQGEVNVTGAIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAEKAPGGPYRLGTSGSCPNATSRSGFFTTMAWAVPRDNNKTATNPLTVEVPHICTKEEDQITVWGFHSDDKTQMKNLYGDSNPQKFTSSTNGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26506 - protein, 585 aa, Artificial Sequence
  hemagglutinin__InfluenzaB__ABN50745
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNITNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMIAIFVVYMVSRDNVSCSICL

SEQ ID NO: 26507 - protein, 583 aa, Artificial Sequence
  hemagglutinin__InfluenzaB__ABN51184
MKAIIVLLMVVTSNADRICTGITSSNSPHVVKTATQGEVNVTGVIPLTTTPTKSHFANLKGTKTRGKLCPNCLNCTDLDVALGRPMCIGTIPSAKASILHEVRPVTSGCFPIMHDRTKIRQLPNLLRGYENIRLSTHNVINAERAPGGPYRLGTSGSCPNVTSKSGFFATMAWAVPRDNKTATNPLTVEVPYICTKGEDQITVWGFHSDNKIQMKNLYGDSNPQKFTSSANGVTTHYVSQIGGFPNQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26508 - protein, 583 aa, Artificial Sequence
  hemagglutinin__InfluenzaB__ABN51195
MKAIIVLLMVVTSNADRICTGITSSNSPHVVKTATQGEVNVTGVIPLTTTPTKSHFANLKGTKTRGKLCPNCLNCTDLDVALGRPMCIGTIPSAKASILHEVRPVTSGCFPIMHDRTKIRQLPNLLRGYENIRLSTHNVINAERAPGGPYRLGTSGSCPNVTSRSGFFATMAWAVPRDNKTATNPLTVEVPYICTKGEDQITVWGFHFDNKIQMKNLYGDSNPQKFTSSANGVTTHYVSQIGGFPNQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26509 - protein, 585 aa, Artificial Sequence
  hemagglutinin__InfluenzaB__ABN58661
MKAIIVLLMVVTSNADRICTGITSSNSPHVVKTATQGEVNVTGVIPLTTTPTKSHFANLKGTKTRGKLCPKCLNCTDLDVALGRPKCTGTIPSAKVSILHEVKPVTSGCFPIMHDRTKIRQLPNLLRGYEHIRLSTHNVINAEKAPGGPYKIGTSGSCPNVTNGNGFFATMAWAVPKNDNNKTATNSLTVEVPYICTEGEDQITVWGFHSDNETQMAKLYGDSKPQKFTSSANGVTTHYVSQIGGFPNQAEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26510 - protein, 584 aa, Artificial Sequence; identical to SEQ ID NO: 26398
  hemagglutinin__InfluenzaB__ABN59445

SEQ ID NO: 26511 - protein, 584 aa, Artificial Sequence
  hemagglutinin__InfluenzaB__ABO72377
MKAIIVLLMVVTSNADRICTGITSSNSPHVVKTATQGEVNVTGAIPLTTTPTKSHFANLKGTKTRGKLCPTCFNCTDLDVALGRPMCVGITPSAKASILHEVRPVTSGCFPIMHDRTKIRQLPNLLRGYEKIRLSTQNVIDAEKAPGGPYRLGTSGSCPNATSKSGFFATMAWAVPRDNNKTATNPLTVEVPHICTKEEDQITVWGFHSDNKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26512 - protein, 584 aa, Artificial Sequence; identical to SEQ ID NO: 26405
  hemagglutinin__InfluenzaB__ABR15973

SEQ ID NO: 26513 - protein, 583 aa, Artificial Sequence
  hemagglutinin__InfluenzaB__ABR15995
MKAIIVLLMVVTSNADRICTGITSSNSPHVVKTATQGEVNVTGVIPLTTTPTKSHFANLKGTKTRGKLCPNCLNCTDLDVALGRPMCIGITPSAKASILHEVRPVTSGCFPIMHDRTKIRQLPNLLRGYEHIRLSTHNVINAERAPGGPYRLGTSGSCPNVTSRSGFFATMAWAVPRDNKTATNPLTVEVPYICTKGEDQITVWGFHSDYKTQMKNLYGDSNPQKFTSSANGITTHYVSQIGGFPNQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26514 - protein, 585 aa, Artificial Sequence
  hemagglutinin__InfluenzaB__ABR16017
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26515 - protein, 585 aa, Artificial Sequence; identical to SEQ ID NO: 26514
  hemagglutinin__InfluenzaB__ACA64899

SEQ ID NO: 26516 - protein, 585 aa, Artificial Sequence
  hemagglutinin__InfluenzaB__ACA64932
MKAIIVLLMVVTSNADRICTGITSSNSPHVVKTATQGEVNVTGVIPLTTTPTKSHFSNLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDINKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDKIAAGTFDAGEFSLPTFDSLNITAASLNDDGLDNHTILLYYSTAASSLAVTLMIAIFVVYMVSRDNVSCSICL

SEQ ID NO: 26517 - protein, 585 aa, Artificial Sequence; identical to SEQ ID NO: 26514
  hemagglutinin__InfluenzaB__ACA64943

SEQ ID NO: 26518 - protein, 585 aa, Artificial Sequence
  hemagglutinin__InfluenzaB__ACA64954
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATSSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26519 - protein, 585 aa, Artificial Sequence; identical to SEQ ID NO: 26514
  hemagglutinin__InfluenzaB__ACA64965

SEQ ID NO: 26520 - protein, 585 aa, Artificial Sequence
  hemagglutinin__InfluenzaB__ACA64998
MKAIIVLLMVVTSNADRICTGITSSNSPHVVKTATQGEVNVTGVIPLTTTPTKSHFANLKGTETRGKLCPKCFNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26521 - protein, 585 aa, Artificial Sequence
  hemagglutinin__InfluenzaB__ACA65020
MKAIIVLLMVVTSNADRICTGITSSNSPHVVKTATQGEVNVTGVIPLTTTPTKSHFSNLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITIWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEVGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26522 - protein, 585 aa, Artificial Sequence; identical to SEQ ID NO: 26520
  hemagglutinin__InfluenzaB__ACA65031

SEQ ID NO: 26523 - protein, 585 aa, Artificial Sequence
  hemagglutinin__InfluenzaB__ACA65042
MKAIIVLLMVVTSNADRICTGITSSNSPHVVKTATQGEVNVTGVIPLTTTPTKSHFSNLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIIVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26524 - protein, 585 aa, Artificial Sequence
  hemagglutinin__InfluenzaB__ACA65053
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTRNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26525 - protein, 585 aa, Artificial Sequence
  hemagglutinin__InfluenzaB__ACA65075
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNITNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLTLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26526 - protein, 585 aa, Artificial Sequence; identical to SEQ ID NO: 26514
  hemagglutinin__InfluenzaB__ACA65086

SEQ ID NO: 26527 - protein, 585 aa, Artificial Sequence; identical to SEQ ID NO: 26514
  hemagglutinin__InfluenzaB__ACA65097

SEQ ID NO: 26528 - protein, 585 aa, Artificial Sequence; identical to SEQ ID NO: 26514
  hemagglutinin__InfluenzaB__ACA96552

SEQ ID NO: 26529 - protein, 585 aa, Artificial Sequence; identical to SEQ ID NO: 26514
  hemagglutinin__InfluenzaB__ACA96563

SEQ ID NO: 26530 - protein, 585 aa, Artificial Sequence; identical to SEQ ID NO: 26514
  hemagglutinin__InfluenzaB__ACA96574

SEQ ID NO: 26531 - protein, 585 aa, Artificial Sequence; identical to SEQ ID NO: 26514
  hemagglutinin__InfluenzaB__ACA96585

SEQ ID NO: 26532 - protein, 585 aa, Artificial Sequence
  hemagglutinin__InfluenzaB__ACA96596
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAIDKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26533 - protein, 585 aa, Artificial Sequence; identical to SEQ ID NO: 26514
  hemagglutinin__InfluenzaB__ACA96607

SEQ ID NO: 26534 - protein, 585 aa, Artificial Sequence
  hemagglutinin__InfluenzaB__ACA96618
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFFLPTFDSLNITAASLNDDGLDNHTILLYYSTAASSLAVTLMIAIFVVYMVSRDNVSCSICL

SEQ ID NO: 26535 - protein, 585 aa, Artificial Sequence; identical to SEQ ID NO: 26514
  hemagglutinin__InfluenzaB__ACA96629

SEQ ID NO: 26536 - protein, 585 aa, Artificial Sequence; identical to SEQ ID NO: 26520
  hemagglutinin__InfluenzaB__ACA96640

SEQ ID NO: 26537 - protein, 584 aa, Artificial Sequence
  hemagglutinin__InfluenzaB__ACD56566
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVVDAENAPGGPYRLGTSGSCPNATSKSGFFATMAWAVPKDNNKNATNPLTVEVPYVCTEGEDQITVWGFHSDNKTQMKNLYGDSNPQKFTSSANGVTTHYVSQIGGFPAQTEDGGLPQSGRIVVDYMVQKPRKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDKIAAGTFNAGEFSLPTFDSLNITAASLNDDGLDNHTILLYYSTAASSLAVTLMLAIFIVYMVSRDNVSCSICL

SEQ ID NO: 26538 - protein, 584 aa, Artificial Sequence
  hemagglutinin__InfluenzaB__ACD56577
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAENAPGGPYRLGTSGSCPNATSKSGFFATMAWAVPKDNNKNATNPLTVEVPYICTEGEDQITVWGFHSDNKAQMKNLYGDSNPQKFTSSANGVTTHYVSQIGGFPAQTEDGGLPQSGRIVVDYMVQKPRKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26539 - protein, 585 aa, Artificial Sequence; identical to SEQ ID NO: 26520
  hemagglutinin__InfluenzaB__ACF41658

SEQ ID NO: 26540 - protein, 585 aa, Artificial Sequence
  hemagglutinin__InfluenzaB__ACF54136
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNKTQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNISCSICL

SEQ ID NO: 26541 - protein, 585 aa, Artificial Sequence; identical to SEQ ID NO: 26514
  hemagglutinin__InfluenzaB__ACF54147

SEQ ID NO: 26542 - protein, 584 aa, Artificial Sequence
  hemagglutinin__InfluenzaB__ACF54158
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSRPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26543 - protein, 584 aa, Artificial Sequence
  hemagglutinin__InfluenzaB__ACF54169
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAENAPGGPYRLGTSGSCPNATSKSGFFATMAWAVPKDNNKNATNPLTVEVPYVCTEGEDQITVWGFHSDNKTPMKNLYGDSNPQKFTSSANGVTTHYVSQIGGFPAQTEDEGIPQSGRIVVDYMVQKPRKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAISKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26544 - protein, 584 aa, Artificial Sequence
  hemagglutinin__InfluenzaB__ACF54180
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAENAPGGPYRLGTSGSCPNATSKSGFFATMAWAVPKDNNKNATNPLTVEVPYVCTEGEDQITVWGFHSDNKTPMKNLYGDSNPQKFTSSANGVTTHYVSQIGGFPAQTEDGGLPQSGRIVVDYMVQKPRKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26545 - protein, 584 aa, Artificial Sequence
  hemagglutinin__InfluenzaB__ACF54202
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAENAPGGPYRLGTSRSCPNATSKSGFFATMAWAVPKDNNKNATNPLTVEVPYVCTEGEDQITVWGFHSDNKTQMKNLYGDSNPQKFTSSANGVTTHYVSQIGGFPAQTEDEGLPQSGRIVVDYMVQKPRKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26546 - protein, 584 aa, Artificial Sequence
  hemagglutinin__InfluenzaB__ACF54213
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSENEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26547 - protein, 585 aa, Artificial Sequence
  hemagglutinin__InfluenzaB__ACF54224
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSSNGVTTHYVSQIGGFPNQTEDGGLPQSGRIVVDYMVQKSGKTGTITYQRGILLPQKVWCASGRSKVIKGSLPLIGEADCLHERYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26548 - protein, 584 aa, Artificial Sequence
  hemagglutinin__InfluenzaB__ACF54257
MKAIIVLLMVVTSNADRICTGITSSNSPHVVKTATQGEVNVTGAIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVIDAEKAPGGPYRLGTSGSCPNATSKSGFFATMAWAVPRENNKTATNPLTVEVPHICTKEEDQITVWGFHSDNKPQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26549 - protein, 584 aa, Artificial Sequence
  hemagglutinin__InfluenzaB__ACF54268
MKAIIVLLMVVTSNADRICTGITSSNSPHVVKTATQGEVNVTGAIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVIDAEKAPGGPYRLGTSGSCPNATSKSGFFATMAWAVPRENNKTATNPLTVEVPHICTKEEDQITVWGFHSDNKIQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAIDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26550 - protein, 584 aa, Artificial Sequence
  hemagglutinin__InfluenzaB__ACF54279
MKAIIVLLMVVTSNADRICTGITSSNSPHVVKTATQGEVNVTGAIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVIDAEKAPGGPYRLGTSGSCPNATSKSGFFATMAWAVPRENNKTATNPLTVEVPHICTKEEDQITVWGFHSDNKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26551 - protein, 584 aa, Artificial Sequence
  hemagglutinin__InfluenzaB__ACF54290
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVVDAENAPGGPYRLGTSGSCPNATSKSGFFATMAWAVPKDNNKNATNPLTVEVPYVCTEGEDQITVWGFHSDKKTQMKNLYGDSNPQKFTSSANGVTTHYVSQIGGFPAQTEDGGLPQSGRIVVDYMVQKPRKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDKIAAGTFNAGEFSLPTFDSLNITAASLNDDGLDNHTILLYYSTAASSLAVTLMLAIFIVYMVSRDNVSCSICL

SEQ ID NO: 26552 - protein, 585 aa, Artificial Sequence
  hemagglutinin__InfluenzaB__ACF54312
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDSETQMAKLYGDSKPQKFTSSSNGVTTHYISQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAIEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26553 - protein, 585 aa, Artificial Sequence
  hemagglutinin__InfluenzaB__ACF54323
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTRNVINAENAPGGPYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26554 - protein, 584 aa, Artificial Sequence
  hemagglutinin__InfluenzaB__ACF54345
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKAQMKNLYGDSNPQKFTSSANGVTTHYVSQIGGFPDQTEDGGLPQSGRIVVDYMIQKPGKTGTIVYQRGVLLPQKVWCASGRSKVIKGSLPLIGEADCLHEKYGGLNKSKPYYTGEHAKAIGNCPIWVKTPLKLANGTKYRPPAKLLRERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26555 - protein, 584 aa, Artificial Sequence
  hemagglutinin__InfluenzaB__ACF54367
MKAIIVLLMVVTSNADRICTGITSSNSPHVVKTATQGEVNVTGVIPLTTAPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDSKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26556 - protein, 584 aa, Artificial Sequence
  hemagglutinin__InfluenzaB__ACN32556
MKAIIVLLMVVTSNADRICTGITSSNSPHVVKTATQGEVNVTGAIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAEKAPGGPYRLGTSGSCPNATSKSGFFATMAWAVPRDNNKTATNPLTVEVPHICTKEEDQITVWGFHSDNKTQMKNLYGDSNPQKFTSFANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26557 - protein, 585 aa, Artificial Sequence
  hemagglutinin__InfluenzaB__ACN32567
MEAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26558 - protein, 585 aa, Artificial Sequence; identical to SEQ ID NO: 26514
  hemagglutinin__InfluenzaB__ACN32578

SEQ ID NO: 26559 - protein, 585 aa, Artificial Sequence
  hemagglutinin__InfluenzaB__ACN32589
MKAIIVLLMVVTSNADRICTGITSSNSPHVVKTATQGEVNVTGVIPLTTTPTKSHFSNLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITIWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26560 - protein, 585 aa, Artificial Sequence
  hemagglutinin__InfluenzaB__ACN32600
MKAIIVLLMVVTSNADRICTGITSSNSPHVVKTATQGEVNVTGVIPLTTTPTKSHFSNLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPARLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26561 - protein, 585 aa, Artificial Sequence; identical to SEQ ID NO: 26525
  hemagglutinin__InfluenzaB__ACN32611

SEQ ID NO: 26562 - protein, 584 aa, Artificial Sequence; identical to SEQ ID NO: 26426
  hemagglutinin__InfluenzaB__ACN32716

SEQ ID NO: 26563 - protein, 585 aa, Artificial Sequence; identical to SEQ ID NO: 26514
  hemagglutinin__InfluenzaB__ACN32771

SEQ ID NO: 26564 - protein, 585 aa, Artificial Sequence; identical to SEQ ID NO: 26520
  hemagglutinin__InfluenzaB__ACN32782

SEQ ID NO: 26565 - protein, 585 aa, Artificial Sequence
  hemagglutinin__InfluenzaB__ACO05957
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNEIQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26566 - protein, 584 aa, Artificial Sequence
  hemagglutinin__InfluenzaB__ACO05968
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEREDQITVWGFHSDNKTQMKNLYGDSNPQKFTSSANGVTTHYVSQIGSFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26567 - protein, 584 aa, Artificial Sequence
  hemagglutinin__InfluenzaB__ACO05979
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGSFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26568 - protein, 584 aa, Artificial Sequence; identical to SEQ ID NO: 26567
  hemagglutinin__InfluenzaB__ACO05990

SEQ ID NO: 26569 - protein, 585 aa, Artificial Sequence
  hemagglutinin__InfluenzaB__ACO06001
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNENQMAKLYGDSKPQKFTSFANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26570 - protein, 584 aa, Artificial Sequence; identical to SEQ ID NO: 26567
  hemagglutinin__InfluenzaB__ACO06012

SEQ ID NO: 26571 - protein, 584 aa, Artificial Sequence; identical to SEQ ID NO: 26567
  hemagglutinin__InfluenzaB__ACO06023

SEQ ID NO: 26572 - protein, 584 aa, Artificial Sequence
  hemagglutinin__InfluenzaB__ACO06062
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIDSFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26573 - protein, 585 aa, Artificial Sequence
  hemagglutinin__InfluenzaB__ACO94661
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFTTMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26574 - protein, 585 aa, Artificial Sequence; identical to SEQ ID NO: 26514
  hemagglutinin__InfluenzaB__ACR15622

SEQ ID NO: 26575 - protein, 585 aa, Artificial Sequence
  hemagglutinin__InfluenzaB__ACR15633
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26576 - protein, 584 aa, Artificial Sequence
  hemagglutinin__InfluenzaB__ACR15644
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAENAPGGPYRLGTSGSCPNATSKSGFFATMAWAVPKDNNKNATNPLTVEVPYVCTEGEDQITVWGFHSDNKIQMKNLYGDSNPQKFTSSANGVTTHYVSQIGGFPAQTEDGGLPQSGRIVVDYMVQKPRKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26577 - protein, 585 aa, Artificial Sequence
  hemagglutinin__InfluenzaB__ACR15655
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNISCSICL

SEQ ID NO: 26578 - protein, 585 aa, Artificial Sequence
  hemagglutinin__InfluenzaB__ACR15666
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHNRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDDETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26579 - protein, 585 aa, Artificial Sequence
  hemagglutinin__InfluenzaB__ACR15677
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNITNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26580 - protein, 584 aa, Artificial Sequence; identical to SEQ ID NO: 26567
  hemagglutinin__InfluenzaB__ACR15710

SEQ ID NO: 26581 - protein, 584 aa, Artificial Sequence
  hemagglutinin__InfluenzaB__ACR15721
MKAIIVLLMVVTSNADRICTGITSSNSPHVVKTATQGEVNVTGVIPLTTTPTKSHFANLKGTKTRGKLCPNCLNCTDLDVALGRPMCVGTTPSAKASILHEVRPVTSGCFPIMHDRTKIRQLPNLLRGYENIRLSTQNVINAEKAPGGPYRLGTSGSCPNATSRSGFFATMAWAVPRDDNKTATNPLTVEVPYVCTEGEDQITVWGFHSDNKAQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26582 - protein, 585 aa, Artificial Sequence
  hemagglutinin__InfluenzaB__ACR39336
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26583 - protein, 584 aa, Artificial Sequence
  hemagglutinin__InfluenzaB__AEA51386
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNYKNATNPLTVEVPYICTEGEGQITVWGFHSDNKPQMKNLYGDSNPQKFTSSASGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVITPQKLANGTTFSPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26584 - protein, 584 aa, Artificial Sequence
  hemagglutinin__InfluenzaB__AEA51387
MKAIIVLLMVVTSNADRICTEITSSNSPLVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKPGKTGPIVYQRGVLLPQKVWCASGRSKVIKGSLPLIGEADCLHEKYGGLNKSKYSHTGDHAKTLGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26585 - protein, 584 aa, Artificial Sequence
  hemagglutinin__InfluenzaB__AEA51388
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPSYTGEHAKAKGNCPIWVNTPLKLANGTKYRPPAKLFKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDKGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26586 - protein, 584 aa, Artificial Sequence
  hemagglutinin__InfluenzaB__AEA51389
MKAIIVLLMVVTSNADRICTGITSSISPLVDKTATQGEVNVTGVIPLTTTPTKSYFANVKGTRTRGKLCPDCLNCTDLDVALGRPMCVGTTPSAKASILHEVRPVTSGCFPIMHDRTKIRQLPNLLRGYENIRLSTQNVIDAQKAPGGPYRLGTSGSCPNATSKIGFFATMACAVPKDNYKNATNPLTVEVPYIRTEGEDQITVWGFHSDNKTQMKNLYGDSNPPKFTSSANGVTTHYVSQTGDFPDQTEDGGLPPSGRIVVDYMMQKPGKTGTIAYQRGVLLPQKVWCASGRSKVIKGSLPLIGEADCLHEKYGGLNKSKPPHTGEHTKAIGNCPIWVKTPLKLANGTKYRPSAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFFLPTFDSLNITAASLNDDGLDNHTILLYYSTAASSLAVTLMLAIFIVYMVSRDNVSCSICL

SEQ ID NO: 26587 - protein, 584 aa, Artificial Sequence
  hemagglutinin__InfluenzaB__AEA51390
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPPSGRIVVDYMMQKPGKTGTIVYQRGGLLPQKVWCASGRSKVIKGSLPLIGEADCLHEKYGGLNKSKPYYTGEHAKAIGNCPIWVKPPLKLANGTKYRPPAKLFKERGFFGALAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26588 - protein, 585 aa, Artificial Sequence
  hemagglutinin__InfluenzaB__AEA51391
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSVNETQMAKLYGDSKPQKFTSSANGVTTHYISQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVPVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26589 - protein, 585 aa, Artificial Sequence
  hemagglutinin__InfluenzaB__AEA51392
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGGTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKNIAPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26590 - protein, 584 aa, Artificial Sequence
  hemagglutinin__InfluenzaB__AEA51395
MKAIIVLLMVVTSNADRICTGITSSNSPHVVKTATLGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQFTVWGFHSDNITQLKNLFGDSNPQRFTSSANGVTTHYVSQIGDFPDQTEDGGLPQSGRIVVDYVMQKPGKTGTIVYQRGVLLPPKVWFARGRSKVIKGSLPLIGEADCIHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26591 - protein, 585 aa, Artificial Sequence
  hemagglutinin__InfluenzaB__AEA51398
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGIGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKSYYTGEHAKAIGNCPIWVKTPLKLANGTKYRPPAHLSYFCGFFGAIAGFLEGGWEGMIAGWNGYTSHGAHGVAVVADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26592 - protein, 585 aa, Artificial Sequence
  hemagglutinin__InfluenzaB__AEA51399
MKAIIVLLMVVTSNADRICTGITASQSPNIDKSSTQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGIGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKSYYTGEHAKAIGNCPIWVKTPLKLANGTKYRPPAHLSYFCGFFGAIAGFLEGGWEGMIAGWNGYTSHGAHGVAVVADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26593 - protein, 585 aa, Artificial Sequence
  hemagglutinin__InfluenzaB__AEG21014
MKAIIVLLMVVTSNADRICTGITSSNSPHVVKTATQGEVNVTGVIPLTTTPTKSHFANLKGTETRGKLCPKCLHCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQMGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLMERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26594 - protein, 584 aa, Artificial Sequence
  hemagglutinin__InfluenzaB__AEG21015
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKNGFFATMAWAVPKDNYKGATNPKTVEVPYICTEGEGQITVWGFHSDNKPQMKNLYGDSNPQKFTSSASGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVITPQKLANGTTFSPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26595 - protein, 584 aa, Artificial Sequence
  hemagglutinin__InfluenzaB__AEG21016
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKRATNPKTVEVPYICTEGEDQITVWGFHSDNKPQMKNPYGDSNPQKFTSSASGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26596 - protein, 584 aa, Artificial Sequence
  hemagglutinin__InfluenzaB__AEG21017
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPSYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26597 - protein, 584 aa, Artificial Sequence
  hemagglutinin__InfluenzaB__AEG21018
MKAIIVLLMVVTSNADRICTGITSSISPLVDKTATQGEVNVTGVIPLTTTPTKSYFANVKGTRTRGKLCPDCLNCTDLDVALGRPMCVGTTPSAKASILHEVRPVTSGCFPIMHDRTKIRQLPNLLRGYENIRLSTQNVIDAQKAPGGPYRLGTSGSCPNATSKIGFFATMACAVPKDNYKNATNPLTVEVPYIRTEGEDQITVWGFHSDNKTQMKNLYGDSNPPKFTSSANGVTTHYVSQTGDFPDQTEDGGLPPSGRIVVDYMMQKPGKTGPIAYQRGVLLPQKVWCASGRSKVIKGSLPLIGEADCLHEKYGGLNKSKYSHTGDHAKTLGNCPIWVKTPLKLANGTKYRPSAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26598 - protein, 584 aa, Artificial Sequence
  hemagglutinin__InfluenzaB__AEG21019
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQTGDFPDQTEDGGLPPSGRIVVDYMMQKPGKTGTIVYQRGVLLPQKVWCASGRSKVIKGSLPLIGEADCLHEKYGGLNKSKPSYTGEHAKAIGNCPIWVKTPLKLANGTKYRPSAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26599 - protein, 585 aa, Artificial Sequence
  hemagglutinin__InfluenzaB__AEG21021
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPILHDRTKIRQLPNLLRGYEHIRLSTHNVINAENAPGGPYKIGTSGSCPNITNGNGFFATMAWAVPKNDKNKTATNPLSIEVPYICTEGEDQITVWGFHSDNETQMAKLYGDSKPQKFTSSANGVATHYVSQIGGFPNQTEDGGLPQSGRIVVDYMVQKSGKTGTITYQRGILLPQKVWCASGRSKVIKGSLPLFGEADCLHEKYGGFNKSKPYYTGEHAKAIGNCPIWVKTPLKLANGTKYRPPAKLFKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26600 - protein, 585 aa, Artificial Sequence
  hemagglutinin__InfluenzaB__AEG21022
MKAIIVLLMVVTSNADRICTGITSSNSPHVVKTATQGEVNVTGVIPLTTTPTKSHFANLKGTETRGKLCPKCLNCTDLDVALGRPKCTGTTPSARASILHEVRPVTSGCFPILHDRTKIRQLPNLLRGYEHIRLSTHNVINAENAPGGPYKIGTSGSCPNITNGNGFFATMAWAVPKNDKNKTATNPLSVEVPYICTEGEDQITVWGFHSDNETQMAKLYGDSKPQKFTSSANGVATHYVSQIGGFPNQTEDGGLPQSGRIVVDYMVQKSGKTGTITYQRGILLPQRGWCASGRSKVIKGSLPLFGEADCLHEKYGGLNKSKPYYTGEHAKAIGNCPIWVKTPLKLANGTKYRPPAKLFKERGFFGAIAGFLEGGWEGMIAGWHGYTSHGAHGVPVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26601 - protein, 584 aa, Artificial Sequence
  hemagglutinin__InfluenzaB__AEG21023
MKAIIVLLMVVTSNADRICTGITSSNSPHVVKTATLGEVNETGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVPTHYVSQIGDFPDPTEDGGLPQSGRIGVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAISGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCSDRIAAGTFDAGEFSLPTFDSLNITAASLNDDGLDNHTILLYYSTAASSLAVTLMIAIFVVYMVSRDNVSCSICL

SEQ ID NO: 26602 - protein, 585 aa, Artificial Sequence
  hemagglutinin__InfluenzaB__AEG21024
MKAIIVLLMVVTSNADRICTGITSSSSPHVVKTATQGEVNVTGVIPLTTTPTKSYFANLKGTETRGKLCPDCPNCTDLDVALGRPNCWGNIPSARVSILHEVRPVTSGCFPIMHDRTKIRQLPNLLRGYEHIRLSTHNVINAENAPGGPYKIGTSGSCPNVTNGNGFFATMAWAVPKDDKNNAATHLLTIEVPFFCTGGEHHIAVWGFPSDNDTLMAKLFGDSNPQMFSSSANGTTTHYVSQIGGFPNQTEDGGLPQSGRIVVDYMVQKSGKTGTIAYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26603 - protein, 584 aa, Artificial Sequence
  hemagglutinin__InfluenzaB__AEG21025
MKAIIVLLMVVTSNADRICTGITSSNSPHVVKTATLGEVNETGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDIKTQMKNLYGDSNPQKFTSSANGVPTHYVSQIGDFPDPTEDGGLPQSGRIGVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAISGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCSDRIAAGTFDAGEFSLPTFDSLNITAASLNDDGLDNHTILLYYSTAASSLAVTLMIAIFVVYMVSRDNVSCSICL

SEQ ID NO: 26604 - protein, 585 aa, Artificial Sequence
  hemagglutinin__InfluenzaB__AEG21026
MKAMMVLLMVVTSNADRICTGITSSNSPHVVKTATQGEVNVTGVIPLTITPTKSHFANLKVKETRGKLCPKCPNCTDLDVALGRPKCTGKIPSARVSILHEDTPVTSGCIPIMHDRTKIRQLPNLLRGYEHIRLSTHNVINAESAPGGPYKIGTSGSCPNVTNGIGFFATMAWAVPKNDKNKTATNPLTIEVPYICTEGEDQITVWGFHFDNETQMAKLYGDSKPQVFTSSANGVNADFVSQIRGFPNQTEDGGLPQSGRIVVDYMVQKSGKTGTITYQRGILLPQKVWCASGRSKVIKESLPLIGEAYFQQEEYGGLNKSKSYYTEEHAKAIGICPIWVKTPLKLANKTKYRPPAHLSYFCGFFGAIAGFLEGGWEGMIAGWNGYTSHGAHGVAVVADLKSTQEAINKITKNLNSLSELEVETLQRLSGAMDELHNEILELDEKVDDHRADTISSQIELPDQLSNDGSINSEDEHLLALERKLKKMLGPSNGDKGSGGIETKHKCNQTCLDRIAAGTFDAGGFSHPTFDSKNVTAASLNDDGLDSGTILLYYSTDVSNLAVTVMMGIFVKYMVSRDNVSCSICL

SEQ ID NO: 26605 - protein, 585 aa, Artificial Sequence
  hemagglutinin__InfluenzaB__AEG21027
MKAIIVLLMVVTSNADRICTGITSSNSPHVVKTATQGEVNVTGVIPLTITPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGIGFFATMAWAVPKNDKNKTATNPLTIEVPYICTEGEDQITVWGFHFDNETQMAKLYGDSKPQKFTSSANGVNADFVSQIGGFPNQTEDGGLPQSGRIVVDYMVQKSGKTGTITYQRGILLPQKVWCASGRSKVIKESLPLIGEAYFQQEEYGGLNKSKSYYTGEHAKAIGNCPIWVKTPLKLANGTKYRPPAHLSYFCGFFGAIAGFLEGGWEGMIAGWNGYTSHGAHGVAVVADLKSTQEAINKITKNLNSLSELEVETLQRLSGAMDELHNEILEIDEKVDDHRADTISSQIELAVLLSNEGIINSEDEHLLALERKLKKMLGPSNGDKGSGGIETKHKCNQTCLDRIAAGTFDAGEFSLPTFDSLNITAASLNDDGLDSGTILLYYSTDVSNLAVTVMMGIFVKYMVSRDNVSCSICL

SEQ ID NO: 26606 - protein, 585 aa, Artificial Sequence
  hemagglutinin__InfluenzaB__AEG21028
MKAIIVLLMVVTSNADRICTGITASQSPNIDKSSTQGEVNVSCVIPLTTTPTKSHFANLKVKETRGKLCPKCPNCTDLDVSLGRPKCTGKIPSARVSILHEVRPVASGGFPIMHDRTKIRQLPNLLRGYEHIRLSTHNVINAENAPGGPYKIGTSGSCPNVTNGIGFFATMAWAVPKNDKNKTATNPLTIEVPYICTEGEDQITVWGFHSDNETQMAKLYGDSKPQKFTSSANGVTTHYAAKRPCFPNQTEDGGLPQSGRIVVDYMVQKSGKTGTITYQRGILLPQKVWCASGRSKVIKGSLPLIGEADCLHEKYGGLNKSKSYYTGEHAKAIGNCPIWVKTPLKLASRTMSKTPAHLSYFCGFFGAIAGFLEGGWEGMIAGWNGYTSHGAHGVAVVADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26607 - protein, 585 aa, Artificial Sequence
  hemagglutinin__InfluenzaB__AEG21029
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGIGFFATMAWAVPKNDKNKTATNPLTIEVPYICTEGEDQITVWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26608 - protein, 585 aa, Artificial Sequence
  hemagglutinin__InfluenzaB__AEO80052
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26609 - protein, 585 aa, Artificial Sequence; identical to SEQ ID NO: 26514
  hemagglutinin__InfluenzaB__AEO80067

SEQ ID NO: 26610 - protein, 584 aa, Artificial Sequence
  hemagglutinin__InfluenzaB__AEO80078
MKEIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26611 - protein, 585 aa, Artificial Sequence
  hemagglutinin__InfluenzaB__AEO80086
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26612 - protein, 584 aa, Artificial Sequence
  hemagglutinin__InfluenzaB__AEO80097
MKAIIVLLMVVTSNADRICTGITSSNSPHVVKTATQGEVNVTGVIPLTTTPTKSHFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26613 - protein, 584 aa, Artificial Sequence; identical to SEQ ID NO: 26426
  hemagglutinin__InfluenzaB__AEO80108

SEQ ID NO: 26614 - protein, 585 aa, Artificial Sequence; identical to SEQ ID NO: 26514
  hemagglutinin__InfluenzaB__AEO80145

SEQ ID NO: 26615 - protein, 585 aa, Artificial Sequence; identical to SEQ ID NO: 26573
  hemagglutinin__InfluenzaB__AEO80154

SEQ ID NO: 26616 - protein, 585 aa, Artificial Sequence
  hemagglutinin__InfluenzaB__AEO80183
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDIETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26617 - protein, 585 aa, Artificial Sequence
  hemagglutinin__InfluenzaB__AEO80194
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCARGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMISRDNVSCSICL

SEQ ID NO: 26618 - protein, 585 aa, Artificial Sequence; identical to SEQ ID NO: 26565
  hemagglutinin__InfluenzaB__AEO80205

SEQ ID NO: 26619 - protein, 585 aa, Artificial Sequence; identical to SEQ ID NO: 26565
  hemagglutinin__InfluenzaB__AEO80216

SEQ ID NO: 26620 - protein, 584 aa, Artificial Sequence
  hemagglutinin__InfluenzaB__AEO80227
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKIQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26621 - protein, 585 aa, Artificial Sequence; identical to SEQ ID NO: 26582
  hemagglutinin__InfluenzaB__AEO80238

SEQ ID NO: 26622 - protein, 585 aa, Artificial Sequence
  hemagglutinin__InfluenzaB__AEP20178
MKAIIVLLMVVTSNADRICTGITSSNSPHVVKTATQGEVNVTGVIPLTTTPTKSHFSNLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26623 - protein, 585 aa, Artificial Sequence
  hemagglutinin__InfluenzaB__AEP20189
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTVLLYYSTAASSLAVTLMIAIFVVYMVSRDNVSCSICL

SEQ ID NO: 26624 - protein, 585 aa, Artificial Sequence; identical to SEQ ID NO: 26514
  hemagglutinin__InfluenzaB__AEP20200

SEQ ID NO: 26625 - protein, 584 aa, Artificial Sequence; identical to SEQ ID NO: 26405
  hemagglutinin__InfluenzaB__AEP20211

SEQ ID NO: 26626 - protein, 584 aa, Artificial Sequence
  hemagglutinin__InfluenzaB__AEP20222
MKAIIVLLMVVTSNADRICTGITSSNSPHVVKTATQGEVNVTGAIPLTTTPTKSHFANLKGTKTRGKLCPTCFNCTDLDVALGRPMCVGITPSAKASILHEVRPVTSGCFPIMHDRTKIRQLPNLLRGYEKIRLSTQNVIDAEKAPGGPYRLGTSGSCPNATSKSGFFATMAWAVPRDNNKTATNPLTVEVPNICTKEEDQITVWGFHSDNKTQMKNLYGDPNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26627 - protein, 584 aa, Artificial Sequence; identical to SEQ ID NO: 26511
  hemagglutinin__InfluenzaB__AEP20233

SEQ ID NO: 26628 - protein, 584 aa, Artificial Sequence
  hemagglutinin__InfluenzaB__AEP20244
MKAIIVLLMVVTSNADRICTGITSSNSPHVVKTATQGEVNVTGAIPLTTTPTKSHFANLKGTKTRGKLCPTCFNCTDLDVALGRPMCMGITPSAKASILHEVRPVTSGCFPIMHDRTKIRQLPNLLRGYEKIRLSTQNVIDAEKAPGGPYRLGTSGSCPNATSKSGFFATMAWAVPRGNNKTATNPLTVEVPHICTKEEDQITVWGFHSDNKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26629 - protein, 585 aa, Artificial Sequence; identical to SEQ ID NO: 26419
  hemagglutinin__InfluenzaB__AEP20255

SEQ ID NO: 26630 - protein, 585 aa, Artificial Sequence
  hemagglutinin__InfluenzaB__AEP20277
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDKIAAGTFDAGEFSLPTFDSLNITAASLNDDGLDNHTILLYYSTAASSLAVTLMIAIFVVYMVSRDNVSCSICL

SEQ ID NO: 26631 - protein, 584 aa, Artificial Sequence
  hemagglutinin__InfluenzaB__AEP20299
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKNNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26632 - protein, 584 aa, Artificial Sequence
  hemagglutinin__InfluenzaB__AEP20310
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTAHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26633 - protein, 585 aa, Artificial Sequence
  hemagglutinin__InfluenzaB__AEP20332
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26634 - protein, 584 aa, Artificial Sequence; identical to SEQ ID NO: 26426
  hemagglutinin__InfluenzaB__AEP20343

SEQ ID NO: 26635 - protein, 584 aa, Artificial Sequence; identical to SEQ ID NO: 26426
  hemagglutinin__InfluenzaB__AEP20354

SEQ ID NO: 26636 - protein, 584 aa, Artificial Sequence; identical to SEQ ID NO: 26426
  hemagglutinin__InfluenzaB__AEP20365

SEQ ID NO: 26637 - protein, 584 aa, Artificial Sequence; identical to SEQ ID NO: 26426
  hemagglutinin__InfluenzaB__AEP20376

SEQ ID NO: 26638 - protein, 585 aa, Artificial Sequence
  hemagglutinin__InfluenzaB__AEP20398
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26639 - protein, 585 aa, Artificial Sequence; identical to SEQ ID NO: 26608
  hemagglutinin__InfluenzaB__AEP20409

SEQ ID NO: 26640 - protein, 585 aa, Artificial Sequence; identical to SEQ ID NO: 26608
  hemagglutinin__InfluenzaB__AEP20420

SEQ ID NO: 26641 - protein, 585 aa, Artificial Sequence; identical to SEQ ID NO: 26608
  hemagglutinin__InfluenzaB__AEP20431

SEQ ID NO: 26642 - protein, 585 aa, Artificial Sequence; identical to SEQ ID NO: 26608
  hemagglutinin__InfluenzaB__AEP20442

SEQ ID NO: 26643 - protein, 585 aa, Artificial Sequence; identical to SEQ ID NO: 26608
  hemagglutinin__InfluenzaB__AEP20453

SEQ ID NO: 26644 - protein, 584 aa, Artificial Sequence; identical to SEQ ID NO: 26426
  hemagglutinin__InfluenzaB__AEQ39027

SEQ ID NO: 26645 - protein, 585 aa, Artificial Sequence
  hemagglutinin__InfluenzaB__AEQ39260
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26646 - protein, 585 aa, Artificial Sequence; identical to SEQ ID NO: 26645
  hemagglutinin__InfluenzaB__AEQ39271

SEQ ID NO: 26647 - protein, 585 aa, Artificial Sequence
  hemagglutinin__InfluenzaB__AEQ39282
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNGDELDNHTILLYYSTAASSLAVTLMIAIFVVYMVSRDNVSCSICL

SEQ ID NO: 26648 - protein, 585 aa, Artificial Sequence
  hemagglutinin__InfluenzaB__AEQ39315
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNGDGLDNHTILLYYSTAASSLAVTLMIAIFVVYMVSRDNVSCSICL

SEQ ID NO: 26649 - protein, 585 aa, Artificial Sequence; identical to SEQ ID NO: 26648
  hemagglutinin__InfluenzaB__AEQ39326

SEQ ID NO: 26650 - protein, 585 aa, Artificial Sequence
  hemagglutinin__InfluenzaB__AEQ39337
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAGNAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKKPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26651 - protein, 585 aa, Artificial Sequence
  hemagglutinin__InfluenzaB__AEQ39348
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHIILLYYSTAASSLAVTLMIAIFVVYMVSRDNVSCSICL

SEQ ID NO: 26652 - protein, 585 aa, Artificial Sequence; identical to SEQ ID NO: 26648
  hemagglutinin__InfluenzaB__AEQ39359

SEQ ID NO: 26653 - protein, 585 aa, Artificial Sequence
  hemagglutinin__InfluenzaB__AEQ39370
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVVNAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26654 - protein, 584 aa, Artificial Sequence; identical to SEQ ID NO: 26426
  hemagglutinin__InfluenzaB__AEQ39392

SEQ ID NO: 26655 - protein, 584 aa, Artificial Sequence; identical to SEQ ID NO: 26426
  hemagglutinin__InfluenzaB__AEQ39429

SEQ ID NO: 26656 - protein, 584 aa, Artificial Sequence; identical to SEQ ID NO: 26426
  hemagglutinin__InfluenzaB__AEQ39440

SEQ ID NO: 26657 - protein, 584 aa, Artificial Sequence; identical to SEQ ID NO: 26426
  hemagglutinin__InfluenzaB__AEQ39451

SEQ ID NO: 26658 - protein, 585 aa, Artificial Sequence; identical to SEQ ID NO: 26638
  hemagglutinin__InfluenzaB__AEQ39462

SEQ ID NO: 26659 - protein, 585 aa, Artificial Sequence; identical to SEQ ID NO: 26645
  hemagglutinin__InfluenzaB__AEQ39484

SEQ ID NO: 26660 - protein, 584 aa, Artificial Sequence; identical to SEQ ID NO: 26405
  hemagglutinin__InfluenzaB__AEQ39506

SEQ ID NO: 26661 - protein, 585 aa, Artificial Sequence
  hemagglutinin__InfluenzaB__AEQ39517
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDNGLDNHTILLYYSTAASSLAVTLMIAIFVVYMVSRDNVSCSICL

SEQ ID NO: 26662 - protein, 585 aa, Artificial Sequence
  hemagglutinin__InfluenzaB__AER27038
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTKGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGIAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26663 - protein, 585 aa, Artificial Sequence; identical to SEQ ID NO: 26608
  hemagglutinin__InfluenzaB__AER27060

SEQ ID NO: 26664 - protein, 585 aa, Artificial Sequence
  hemagglutinin__InfluenzaB__AET10061
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAKNAPGGPYKIGTSGSCPNVTNGNGFFATMAWAVPKNDKNRTATNSLTIEVPYICKEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26665 - protein, 584 aa, Artificial Sequence
  hemagglutinin__InfluenzaB__AET10062
MKAIIVLLMVVTSNADRICTGITSSNSPHVVKTATQGEVNVTGVIPLTITPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICKEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26666 - protein, 584 aa, Artificial Sequence
  hemagglutinin__InfluenzaB__AET10064
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITIWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26667 - protein, 584 aa, Artificial Sequence
  hemagglutinin__InfluenzaB__AET10065
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICKEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26668 - protein, 584 aa, Artificial Sequence; identical to SEQ ID NO: 26667
  hemagglutinin__InfluenzaB__AET10066

SEQ ID NO: 26669 - protein, 584 aa, Artificial Sequence
  hemagglutinin__InfluenzaB__AET10067
MKAIIVLLMVVTSNADRICTGITSSNSPHVVKTATQGEVNVTGVIPLTATPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICKEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26670 - protein, 584 aa, Artificial Sequence
  hemagglutinin__InfluenzaB__AET10068
MKAIIVLLMVVTSNADRICTGITSSNSPHVVKTATQGEVNVTGVIPLTTAPTKSYFANLKGTRTRGKLCPDCLNCTDLDVALGRPMCAGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICKEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26671 - protein, 584 aa, Artificial Sequence; identical to SEQ ID NO: 26667
  hemagglutinin__InfluenzaB__AET10069

SEQ ID NO: 26672 - protein, 585 aa, Artificial Sequence
  hemagglutinin__InfluenzaB__AET10070
MKAIIVLLMVVTSNADRICTGITSSNSPHVVKTATQGEVKVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26673 - protein, 585 aa, Artificial Sequence; identical to SEQ ID NO: 26608
  hemagglutinin__InfluenzaB__AET10071

SEQ ID NO: 26674 - protein, 585 aa, Artificial Sequence; identical to SEQ ID NO: 26608
  hemagglutinin__InfluenzaB__AET10072

SEQ ID NO: 26675 - protein, 584 aa, Artificial Sequence
  hemagglutinin__InfluenzaB__AET10073
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGCENIRLSTQNVIDAEKAPGGPYRLGTSGSCPNATSKIGFFATMAWAVPKDNYKNATNPLTVEVPYICKEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26676 - protein, 585 aa, Artificial Sequence
  hemagglutinin__InfluenzaB__AET10074
MKAIIVLLMVVTSNADRICTGITSSNSPHVVKTATQGEVNVTGVIPLTTTPTRSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGRTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLDDDGLDNHTILLYYSTAASSLAVTLMIAIFVVYMVSRDNVSCSICL

SEQ ID NO: 26677 - protein, 585 aa, Artificial Sequence; identical to SEQ ID NO: 26608
  hemagglutinin__InfluenzaB__AET10076

SEQ ID NO: 26678 - protein, 585 aa, Artificial Sequence; identical to SEQ ID NO: 26608
  hemagglutinin__InfluenzaB__AET10077

SEQ ID NO: 26679 - protein, 585 aa, Artificial Sequence
  hemagglutinin__InfluenzaB__AET10078
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSVLHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNEDGLDNHAILLYYSTAASSLAVTLMIAIFVVYMVSRDNVSCSICL

SEQ ID NO: 26680 - protein, 585 aa, Artificial Sequence
  hemagglutinin__InfluenzaB__AET10079
MKAIIVLLMVVTSNADGICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFTTMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVENLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26681 - protein, 585 aa, Artificial Sequence; identical to SEQ ID NO: 26608
  hemagglutinin__InfluenzaB__AET10080

SEQ ID NO: 26682 - protein, 585 aa, Artificial Sequence; identical to SEQ ID NO: 26608
  hemagglutinin__InfluenzaB__AET10081

SEQ ID NO: 26683 - protein, 585 aa, Artificial Sequence
  hemagglutinin__InfluenzaB__AET10082
MKAIIVLLMVVTSNADRICTGITSSNSPHIVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26684 - protein, 585 aa, Artificial Sequence
  hemagglutinin__InfluenzaB__AET10083
MKAIIVLLMVVTSNADRICTGITSSNSPHVVKTATQGEVNVTGVIPLTTTPTKSHFANLKGTETRGKLCPKCLNCTDLDVALGRPKCTGKVPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26685 - protein, 585 aa, Artificial Sequence; identical to SEQ ID NO: 26645
  hemagglutinin__InfluenzaB__AET10084

SEQ ID NO: 26686 - protein, 585 aa, Artificial Sequence; identical to SEQ ID NO: 26608
  hemagglutinin__InfluenzaB__AET10085

SEQ ID NO: 26687 - protein, 585 aa, Artificial Sequence; identical to SEQ ID NO: 26648
  hemagglutinin__InfluenzaB__AET43124

SEQ ID NO: 26688 - protein, 585 aa, Artificial Sequence; identical to SEQ ID NO: 26648
  hemagglutinin__InfluenzaB__AET43135

SEQ ID NO: 26689 - protein, 585 aa, Artificial Sequence; identical to SEQ ID NO: 26648
  hemagglutinin__InfluenzaB__AET43146

SEQ ID NO: 26690 - protein, 585 aa, Artificial Sequence; identical to SEQ ID NO: 26648
  hemagglutinin__InfluenzaB__AET43157

SEQ ID NO: 26691 - protein, 585 aa, Artificial Sequence
  hemagglutinin__InfluenzaB__AET43168
MKAIIVLLMVVTSNADRICTGITSSNSPHVVKTATQGEVNVTGVIPLTTTPTKSHFANLKGTETRGKLCPKCLNCTDLDVTLGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26692 - protein, 585 aa, Artificial Sequence; identical to SEQ ID NO: 26648
  hemagglutinin__InfluenzaB__AET43179

SEQ ID NO: 26693 - protein, 585 aa, Artificial Sequence; identical to SEQ ID NO: 26648
  hemagglutinin__InfluenzaB__AET43190

SEQ ID NO: 26694 - protein, 585 aa, Artificial Sequence
  hemagglutinin__InfluenzaB__AET43201
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAGNAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26695 - protein, 585 aa, Artificial Sequence; identical to SEQ ID NO: 26648
  hemagglutinin__InfluenzaB__AET43212

SEQ ID NO: 26696 - protein, 585 aa, Artificial Sequence; identical to SEQ ID NO: 26648
  hemagglutinin__InfluenzaB__AET43223

SEQ ID NO: 26697 - protein, 585 aa, Artificial Sequence; identical to SEQ ID NO: 26694
  hemagglutinin__InfluenzaB__AET50943

SEQ ID NO: 26698 - protein, 585 aa, Artificial Sequence; identical to SEQ ID NO: 26648
  hemagglutinin__InfluenzaB__AET50954

SEQ ID NO: 26699 - protein, 585 aa, Artificial Sequence; identical to SEQ ID NO: 26648
  hemagglutinin__InfluenzaB__AET50965

SEQ ID NO: 26700 - protein, 585 aa, Artificial Sequence; identical to SEQ ID NO: 26648
  hemagglutinin__InfluenzaB__AET50976

SEQ ID NO: 26701 - protein, 585 aa, Artificial Sequence; identical to SEQ ID NO: 26648
  hemagglutinin__InfluenzaB__AET74255

SEQ ID NO: 26702 - protein, 585 aa, Artificial Sequence; identical to SEQ ID NO: 26694
  hemagglutinin__InfluenzaB__AET74277

SEQ ID NO: 26703 - protein, 585 aa, Artificial Sequence; identical to SEQ ID NO: 26648
  hemagglutinin__InfluenzaB__AET74288

SEQ ID NO: 26704 - protein, 585 aa, Artificial Sequence
  hemagglutinin__InfluenzaB__AET74299
MKAIIVLLMVVTSNADRICTGITSSNSPHVVKTATQGEVNVTGVIPLTTTPTKSHFANLKGTETRGKLCPKCLNCTDLDVTLGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITNNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26705 - protein, 585 aa, Artificial Sequence; identical to SEQ ID NO: 26648
  hemagglutinin__InfluenzaB__AET74329

SEQ ID NO: 26706 - protein, 585 aa, Artificial Sequence; identical to SEQ ID NO: 26648
  hemagglutinin__InfluenzaB__AET74340

SEQ ID NO: 26707 - protein, 585 aa, Artificial Sequence; identical to SEQ ID NO: 26648
  hemagglutinin__InfluenzaB__AET74351

SEQ ID NO: 26708 - protein, 585 aa, Artificial Sequence; identical to SEQ ID NO: 26645
  hemagglutinin__InfluenzaB__AEY69077

SEQ ID NO: 26709 - protein, 585 aa, Artificial Sequence; identical to SEQ ID NO: 26645
  hemagglutinin__InfluenzaB__AFB77676

SEQ ID NO: 26710 - protein, 585 aa, Artificial Sequence
  hemagglutinin__InfluenzaB__AFB77677
MKAIIVLLMVVTSNADRICTGITSSNSPHVVKTATQGEVNVTGVIPLTTTPTKSHFANLKGTETRGKLCPKCFNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26711 - protein, 585 aa, Artificial Sequence; identical to SEQ ID NO: 26645
  hemagglutinin__InfluenzaB__AFB77678

SEQ ID NO: 26712 - protein, 585 aa, Artificial Sequence; identical to SEQ ID NO: 26645
  hemagglutinin__InfluenzaB__AFB77679

SEQ ID NO: 26713 - protein, 585 aa, Artificial Sequence
  hemagglutinin__InfluenzaB__AFB77680
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPITSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26714 - protein, 585 aa, Artificial Sequence; identical to SEQ ID NO: 26645
  hemagglutinin__InfluenzaB__AFB77681

SEQ ID NO: 26715 - protein, 585 aa, Artificial Sequence
  hemagglutinin__InfluenzaB__AFB77682
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITQNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26716 - protein, 585 aa, Artificial Sequence; identical to SEQ ID NO: 26645
  hemagglutinin__InfluenzaB__AFB77683

SEQ ID NO: 26717 - protein, 585 aa, Artificial Sequence; identical to SEQ ID NO: 26645
  hemagglutinin__InfluenzaB__AFB77684

SEQ ID NO: 26718 - protein, 585 aa, Artificial Sequence
  hemagglutinin__InfluenzaB__AFB77685
MKAIIVLLMVVTSNADRICTGITSSNSPHVVKTATQGEVNVTGVIPLTTTPTKSHFANLKGTETRGKLCPKCLNCTDLDVALGRPKCTGKTPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYISQIGGFPNQTEDGGLPQSGRIVVDYMVQKSEKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26719 - protein, 585 aa, Artificial Sequence
  hemagglutinin__InfluenzaB__AFB77686
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQISGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITQNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26720 - protein, 585 aa, Artificial Sequence
  hemagglutinin__InfluenzaB__AFB77687
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIKLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26721 - protein, 585 aa, Artificial Sequence
  hemagglutinin__InfluenzaB__AFB77688
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKAPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26722 - protein, 585 aa, Artificial Sequence; identical to SEQ ID NO: 26645
  hemagglutinin__InfluenzaB__AFB77689

SEQ ID NO: 26723 - protein, 585 aa, Artificial Sequence; identical to SEQ ID NO: 26645
  hemagglutinin__InfluenzaB__AFB77690

SEQ ID NO: 26724 - protein, 585 aa, Artificial Sequence; identical to SEQ ID NO: 26683
  hemagglutinin__InfluenzaB__AFE00360

SEQ ID NO: 26725 - protein, 585 aa, Artificial Sequence; identical to SEQ ID NO: 26683
  hemagglutinin__InfluenzaB__AFF18534

SEQ ID NO: 26726 - protein, 585 aa, Artificial Sequence; identical to SEQ ID NO: 26683
  hemagglutinin__InfluenzaB__AFF18543

SEQ ID NO: 26727 - protein, 585 aa, Artificial Sequence; identical to SEQ ID NO: 26645
  hemagglutinin__InfluenzaB__AFG48978

SEQ ID NO: 26728 - protein, 585 aa, Artificial Sequence; identical to SEQ ID NO: 26645
  hemagglutinin__InfluenzaB__AFG48997

SEQ ID NO: 26729 - protein, 585 aa, Artificial Sequence
  hemagglutinin__InfluenzaB__AFG48998
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFETMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26730 - protein, 584 aa, Artificial Sequence
  hemagglutinin__InfluenzaB__AFG49012
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIASFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26731 - protein, 584 aa, Artificial Sequence
  hemagglutinin__InfluenzaB__AFG49013
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26732 - protein, 584 aa, Artificial Sequence
  hemagglutinin__InfluenzaB__AFH57865
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTPMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26733 - protein, 584 aa, Artificial Sequence
  hemagglutinin__InfluenzaB__AFH57876
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKNQMKNLYGDSNPQKFTSSANGVTTHYVSQIGSFPDQTEDGGLPQSGRIVVDYMMQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26734 - protein, 584 aa, Artificial Sequence
  hemagglutinin__InfluenzaB__AFH57942
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKNQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26735 - protein, 583 aa, Artificial Sequence
  hemagglutinin__InfluenzaB__AFH57986
MKAIIVLLMVVTSNADRICTGITSSNSPHVVKTATQGEVNVTGVIPLTTTPTKSHFANLKGTKTRGKLCPNCLNCTDLDVALGRPMCVGTTPSAKASILHEVRPVTSGCFPIMHDRTKIRQLPNLLRGYENIRLSTQNVINAERAPGGPYRLGTSGSCPNVTSRDGFFATMAWAVPRDNKTATNPLTVEVPYICTKGEDQITVWGFHSDDKTQMKNLYGDSNPQKFTSSANGVTTHYVSQIGGFPNQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 26736 - protein, 585 aa, Artificial Sequence
  hemagglutinin__InfluenzaB__AFH58249
MKAIIVLLMVVTSNADRICTGITSSNSPHVVKTATQGEVNVTGVIPLTTTPTKSHFANLKGTKTRGKLCPKCLNCTDLDVALGRPKCTGNIPPAKVSILHEVRPVTSGCFPIMHDRTKIRQLPNLLRGYERIRLSNHNVINAEEAPGGPYKIGTSGSCPNVTNGNGFFATMAWAVPKNENNKTATNSLTIEVPYICTEGEDQITVWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPATLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMIAIFVVYMVSRDNVSCSICL

SEQ ID NO: 26737 - protein, 585 aa, Artificial Sequence
  hemagglutinin__InfluenzaB__AFH58260
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNEIQMAKLYGDSKPQKFTSSSNGVTTHYVSQIGGFPNQTEDGGLPQSGRIVVDYMVQKSGKTGTITYQRGILLPQKVWCASGRSKVIKGSLPLIGEADCLHERYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26738 - protein, 584 aa, Artificial Sequence
  hemagglutinin__InfluenzaB__AFH58271
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVKPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGSFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26739 - protein, 584 aa, Artificial Sequence; identical to SEQ ID NO: 26738
  hemagglutinin__InfluenzaB__AFH58282

SEQ ID NO: 26740 - protein, 585 aa, Artificial Sequence
  hemagglutinin__InfluenzaB__AFH58293
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDDETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26741 - protein, 584 aa, Artificial Sequence
  hemagglutinin__InfluenzaB__AFH58304
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDDKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26742 - protein, 584 aa, Artificial Sequence; identical to SEQ ID NO: 26741
  hemagglutinin__InfluenzaB__AFH58315

SEQ ID NO: 26743 - protein, 584 aa, Artificial Sequence
  hemagglutinin__InfluenzaB__AFH58326
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKAQMKNLYGDSNPQKFTSSANGVTTHYVSQIGDFPDQTEDGGPPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26744 - protein, 584 aa, Artificial Sequence
  hemagglutinin__InfluenzaB__AFH58337
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKAQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26745 - protein, 585 aa, Artificial Sequence
  hemagglutinin__InfluenzaB__AFH58348
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSAHNVINAENAPGGPYKIGTSGSCPNVTNGNGFFATMAWAVPKNDNNKTATNSLTIEVPYICTEGEDQITVWGFHSDKETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMIAIFVVYMVSRDNVSCSICL

SEQ ID NO: 26746 - protein, 585 aa, Artificial Sequence
  hemagglutinin__InfluenzaB__AFH58370
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSAHNVINAENAPGGPYKIGTSGSCPNVTNGNGFFATMAWAVPKNDNNKTATNSLTIEVPYICTEGEDQITVWGFHSDNEIQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMIAIFVVYMVSRDNVSCSICL

SEQ ID NO: 26747 - protein, 585 aa, Artificial Sequence
  hemagglutinin__InfluenzaB__AFH58392
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNEIQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26748 - protein, 585 aa, Artificial Sequence; identical to SEQ ID NO: 26740
  hemagglutinin__InfluenzaB__AFH58403

SEQ ID NO: 26749 - protein, 585 aa, Artificial Sequence; identical to SEQ ID NO: 26740
  hemagglutinin__InfluenzaB__AFH58414

SEQ ID NO: 26750 - protein, 585 aa, Artificial Sequence; identical to SEQ ID NO: 26740
  hemagglutinin__InfluenzaB__AFH58425

SEQ ID NO: 26751 - protein, 585 aa, Artificial Sequence; identical to SEQ ID NO: 26740
  hemagglutinin__InfluenzaB__AFH58436

SEQ ID NO: 26752 - protein, 585 aa, Artificial Sequence
  hemagglutinin__InfluenzaB__AFH58458
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTNNVINAENAPGGPYKIGTSGSCPNVTNGNGFFATMAWAVPKNDKNKTATNPLTIEVPYICTEGEDQITVWGFHSDNEIQMAKLYGDSRPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26753 - protein, 585 aa, Artificial Sequence; identical to SEQ ID NO: 26752
  hemagglutinin__InfluenzaB__AFH58469

SEQ ID NO: 26754 - protein, 584 aa, Artificial Sequence; identical to SEQ ID NO: 26734
  hemagglutinin__InfluenzaB__AFH58480

SEQ ID NO: 26755 - protein, 584 aa, Artificial Sequence
  hemagglutinin__InfluenzaB__AFH58502
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDDKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26756 - protein, 585 aa, Artificial Sequence
  hemagglutinin__InfluenzaB__AFH58513
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDDETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26757 - protein, 585 aa, Artificial Sequence; identical to SEQ ID NO: 26756
  hemagglutinin__InfluenzaB__AFH58524

SEQ ID NO: 26758 - protein, 584 aa, Artificial Sequence
  hemagglutinin__InfluenzaB__AFH58535
MKAIIVLLMVVTSNADRICTGITSSNSPHVVKTATQGEVNVTGVIPLTTTPTKSHFANLKGTQTRGKLCPNCFNCTDLDVALGRPKCMGNTPSAKVSILHEVKPATSGCFPIMHDRTKIRQLPNLLRGYENIRLSTSNVINTETAPGGPYKVGTSGSCPNVANGNGFFNTMAWVIPKDNNKTAINPVTVEVPYICSEGEDQITVWGFHSDDKTQMERLYGDSNPQKFTSSANGVTTHYVSQIGGFPNQTEDEGLKQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNYLSELEVKNLQRLSGAMNELHDEILELDEKVDDLRADTISSQIELAVLLSNEGIINSEDEHLLALERKLKKMLGPSAVEIGNGCFETKHKCNQTCLDRIAAGTFNAGDFSLPTFDSLNITAASLNDDGLDNHTILLYYSTAASSLAVTLMIAIFIVYMVSRDNVSCSICL

SEQ ID NO: 26759 - protein, 583 aa, Artificial Sequence
  hemagglutinin__InfluenzaB__AFH58557
MKAIIVLLMVVTSNADRICTGITSSNSPHVVKTATQGEVNVTGVIPLTTTPTKSHFANLKGTKTRGKLCPNCLNCTDLDVALGRPMCVGTTPSAKASILHEVRPVTSGCFPIMHDRTKIRQLPNLLRGYENIRLSTQNVINAERAPGGPYRLGTSGSCPNVTSRDGFFATMAWAVPRDNKTATNPLTVEVPYICTKGEDQITVWGFHSDDKTQMKNLYGDSNPQKFTSSANGVTTHYVSQIGGFPNQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSFPTFDSLNITAASLNDDGLDNHTILLYYSTAASSLAVTLMIAIFIVYMVSRDNVSCSICL

SEQ ID NO: 26760 - protein, 584 aa, Artificial Sequence
  hemagglutinin__InfluenzaB__AFJ76224
MKAIIVLLMVVTSNADRICTGITSSNSPHVVKTATQGEVNVTGVIPLTTTPTKSHFANLKGTKTRGKLCPTCLNCTDLDVALGSPMCVGITPSAKASILHEVRPVTSGCFPIMHDRTKIRQLPNLLRGYEKIRLSTQNVINIEKAPGGPYRLGTSGSCPNATSRSGFFATMAWAVPRDNNKTATNPLTVEVPHICTKEEDQITVWGFHSDNKTQMKNLYGDSNPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26761 - protein, 584 aa, Artificial Sequence
  hemagglutinin__InfluenzaB__AFJ76235
MKAIIVLLMVVTSNADRICTGITSSNSPHVVKTATQGEVNVTGVIPLTTTPTKSHFANLKGTKTRGKLCPTCLNCTDLDVALGSPMCVGITPSAKASILHEVRPVTSRCFPIMHDRTKIRQLPNLLRGYEKIRLSTQNVINIEKAPGGPYRLGTSGSCPNATSRSGFFATMAWAVPRDNNKTATNPLTVEVPHICTKEEDQITVWGFHSDNKTQMKNLYGDSNPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26762 - protein, 584 aa, Artificial Sequence; identical to SEQ ID NO: 26760
  hemagglutinin__InfluenzaB__AFJ76246

SEQ ID NO: 26763 - protein, 585 aa, Artificial Sequence; identical to SEQ ID NO: 26514
  hemagglutinin__InfluenzaB__AFJ76268

SEQ ID NO: 26764 - protein, 585 aa, Artificial Sequence; identical to SEQ ID NO: 26565
  hemagglutinin__InfluenzaB__AFJ76301

SEQ ID NO: 26765 - protein, 584 aa, Artificial Sequence; identical to SEQ ID NO: 26426
  hemagglutinin__InfluenzaB__AFJ76323

SEQ ID NO: 26766 - protein, 585 aa, Artificial Sequence
  hemagglutinin__InfluenzaB__AFJ76334
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWKGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAVFVVYMVSRDNVSCSICL

SEQ ID NO: 26767 - protein, 585 aa, Artificial Sequence; identical to SEQ ID NO: 26514
  hemagglutinin__InfluenzaB__AFJ77327

SEQ ID NO: 26768 - protein, 584 aa, Artificial Sequence; identical to SEQ ID NO: 26426
  hemagglutinin__InfluenzaB__AFJ77369

SEQ ID NO: 26769 - protein, 584 aa, Artificial Sequence; identical to SEQ ID NO: 26426
  hemagglutinin__InfluenzaB__AFJ77380

SEQ ID NO: 26770 - protein, 584 aa, Artificial Sequence
  hemagglutinin__InfluenzaB__AFJ80139
MKAIIVLLMVVTSNADRICTGITSSNSPHVVKTATQGEVNVTGVIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTVEVPYICTKEEDQITVWGFHSDNKTQMKNLYGDSNPQKFTSSANGVTTHYVSQIGGFPDQTEDGGLPQSGRIVVDYMVQKPGKTGTIVYQRGILLPQKVWCASGRSKVIKGFLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26771 - protein, 584 aa, Artificial Sequence
  hemagglutinin__InfluenzaB__AFJ80150
MKAIIVLLMVVTSNADRICTGITSSNSPHVVKTATQGEVNVTGVIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTVEVPYICTKEEDQITVWGFHSDNKTQMKNLYGDSNPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26772 - protein, 584 aa, Artificial Sequence
  hemagglutinin__InfluenzaB__AFJ80161
MKAIIVLLMVVTSNADRICTGITSSNSPHVVKTATQGEVNVTGAIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTVEVPHICTKEEDQITVWGFHSDNKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMIFRDNVSCSICL

SEQ ID NO: 26773 - protein, 584 aa, Artificial Sequence
  hemagglutinin__InfluenzaB__AFJ80172
MKAIIVLLMVVTSNADRICTGITSSNSPHVVKTATQGEVNVTGVIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTVEVPYICTKEEDQITVWGFHSDNKTQMKNLYGDSNPQKFTSSANGVTTHYVSQIGDFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26774 - protein, 584 aa, Artificial Sequence; identical to SEQ ID NO: 26760
  hemagglutinin__InfluenzaB__AFJ80183

SEQ ID NO: 26775 - protein, 584 aa, Artificial Sequence; identical to SEQ ID NO: 26771
  hemagglutinin__InfluenzaB__AFJ80194

SEQ ID NO: 26776 - protein, 584 aa, Artificial Sequence; identical to SEQ ID NO: 26760
  hemagglutinin__InfluenzaB__AFJ80205

SEQ ID NO: 26777 - protein, 584 aa, Artificial Sequence; identical to SEQ ID NO: 26405
  hemagglutinin__InfluenzaB__AFJ80216

SEQ ID NO: 26778 - protein, 584 aa, Artificial Sequence; identical to SEQ ID NO: 26760
  hemagglutinin__InfluenzaB__AFJ80227

SEQ ID NO: 26779 - protein, 585 aa, Artificial Sequence
  hemagglutinin__InfluenzaB__AFJ80238
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSIHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26780 - protein, 584 aa, Artificial Sequence
  hemagglutinin__InfluenzaB__AFJ80656
MKAIIVLLMVVTSNADRICTGITSSNSPHVVRTATQGEVNVTGVIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTVEVPHICTKEEDQITVWGFHSDNKTQMKNLYGDSNPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 26781 - protein, 584 aa, Artificial Sequence; identical to SEQ ID NO: 26760
  hemagglutinin__InfluenzaB__AFJ80667

SEQ ID NO: 26782 - protein, 584 aa, Artificial Sequence; identical to SEQ ID NO: 26760
  hemagglutinin__InfluenzaB__AFJ80678

SEQ ID NO: 26783 - protein, 584 aa, Artificial Sequence; identical to SEQ ID NO: 26760
  hemagglutinin__InfluenzaB__AFJ80689

SEQ ID NO: 26784 - protein, 584 aa, Artificial Sequence
  hemagglutinin__InfluenzaB__AFJ80711
MKAIIVLLMVVTSNADRICTGITSSNSPHVVKTATQGEVNVTGVIPLTTTPIKSYFANLKGTKTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYVCTEGEDQITVWGFHSDNKTQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26785 - protein, 584 aa, Artificial Sequence; identical to SEQ ID NO: 26784
  hemagglutinin__InfluenzaB__AFJ80722

SEQ ID NO: 26786 - protein, 584 aa, Artificial Sequence
  hemagglutinin__InfluenzaB__AFJ80733
MKAIIVLLMVVTSNADRICTGITSSNSPHVVKTATQGEVNVTGVIPLTTTPTKSYFANLKGTRTRGKLCPDCLNCTDLDVALGRPMCMGTTPSAKASILHEVRPVTSGCFPIMHDRTKIRQLPNLLRGYENIRLSTQNVIDAEKAPGGPYRLGTSGSCPDATNKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26787 - protein, 585 aa, Artificial Sequence; identical to SEQ ID NO: 26514
  hemagglutinin__InfluenzaB__AFJ80744

SEQ ID NO: 26788 - protein, 585 aa, Artificial Sequence; identical to SEQ ID NO: 26514
  hemagglutinin__InfluenzaB__AFJ80755

SEQ ID NO: 26789 - protein, 585 aa, Artificial Sequence; identical to SEQ ID NO: 26514
  hemagglutinin__InfluenzaB__AFJ80781

SEQ ID NO: 26790 - protein, 585 aa, Artificial Sequence; identical to SEQ ID NO: 26514
  hemagglutinin__InfluenzaB__AFJ80792

SEQ ID NO: 26791 - protein, 585 aa, Artificial Sequence; identical to SEQ ID NO: 26514
  hemagglutinin__InfluenzaB__AFJ80803

SEQ ID NO: 26792 - protein, 585 aa, Artificial Sequence; identical to SEQ ID NO: 26514
  hemagglutinin__InfluenzaB__AFJ80814

SEQ ID NO: 26793 - protein, 585 aa, Artificial Sequence
  hemagglutinin__InfluenzaB__AFJ80825
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPITSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26794 - protein, 585 aa, Artificial Sequence; identical to SEQ ID NO: 26514
  hemagglutinin__InfluenzaB__AFJ80836

SEQ ID NO: 26795 - protein, 585 aa, Artificial Sequence; identical to SEQ ID NO: 26582
  hemagglutinin__InfluenzaB__AFJ80847

SEQ ID NO: 26796 - protein, 585 aa, Artificial Sequence; identical to SEQ ID NO: 26514
  hemagglutinin__InfluenzaB__AFJ80858

SEQ ID NO: 26797 - protein, 585 aa, Artificial Sequence; identical to SEQ ID NO: 26514
  hemagglutinin__InfluenzaB__AFJ80869

SEQ ID NO: 26798 - protein, 585 aa, Artificial Sequence; identical to SEQ ID NO: 26514
  hemagglutinin__InfluenzaB__AFJ80880

SEQ ID NO: 26799 - protein, 585 aa, Artificial Sequence; identical to SEQ ID NO: 26565
  hemagglutinin__InfluenzaB__AFJ80891

SEQ ID NO: 26800 - protein, 585 aa, Artificial Sequence; identical to SEQ ID NO: 26565
  hemagglutinin__InfluenzaB__AFJ80902

SEQ ID NO: 26801 - protein, 585 aa, Artificial Sequence; identical to SEQ ID NO: 26514
  hemagglutinin__InfluenzaB__AFJ80913

SEQ ID NO: 26802 - protein, 585 aa, Artificial Sequence
  hemagglutinin__InfluenzaB__AFJ80924
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICAEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26803 - protein, 585 aa, Artificial Sequence; identical to SEQ ID NO: 26565
  hemagglutinin__InfluenzaB__AFJ80935

SEQ ID NO: 26804 - protein, 584 aa, Artificial Sequence; identical to SEQ ID NO: 26426
  hemagglutinin__InfluenzaB__AFJ80946

SEQ ID NO: 26805 - protein, 585 aa, Artificial Sequence
  hemagglutinin__InfluenzaB__AFJ80957
MKAIIVLLMVATSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMIAIFVVYMVSRDNVSCSICL

SEQ ID NO: 26806 - protein, 584 aa, Artificial Sequence; identical to SEQ ID NO: 26426
  hemagglutinin__InfluenzaB__AFJ80968

SEQ ID NO: 26807 - protein, 584 aa, Artificial Sequence; identical to SEQ ID NO: 26426
  hemagglutinin__InfluenzaB__AFJ80979

SEQ ID NO: 26808 - protein, 584 aa, Artificial Sequence
  hemagglutinin__InfluenzaB__AFJ80990
MKAIIVLLMVVTSNADRICTGITSSNSPHVVKTATQGEVNVTGVIPLTTTPTKSYFANLKGTRTRGKLCPDCLNCTDLDVALGRPMCVGTTPSAEASILHEVRPVTSGCFPIMHDRTKIRQLPNLLRGYENIRLSTQNVIDAEKAPGGPYRLGTSGSCPNATNKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26809 - protein, 584 aa, Artificial Sequence; identical to SEQ ID NO: 26426
  hemagglutinin__InfluenzaB__AFJ81001

SEQ ID NO: 26810 - protein, 584 aa, Artificial Sequence; identical to SEQ ID NO: 26426
  hemagglutinin__InfluenzaB__AFJ84360

SEQ ID NO: 26811 - protein, 585 aa, Artificial Sequence; identical to SEQ ID NO: 26514
  hemagglutinin__InfluenzaB__AFJ90395

SEQ ID NO: 26812 - protein, 584 aa, Artificial Sequence; identical to SEQ ID NO: 26426
  hemagglutinin__InfluenzaB__AFJ90406

SEQ ID NO: 26813 - protein, 584 aa, Artificial Sequence; identical to SEQ ID NO: 26426
  hemagglutinin__InfluenzaB__AFJ90417

SEQ ID NO: 26814 - protein, 584 aa, Artificial Sequence; identical to SEQ ID NO: 26426
  hemagglutinin__InfluenzaB__AFJ90428

SEQ ID NO: 26815 - protein, 584 aa, Artificial Sequence; identical to SEQ ID NO: 26426
  hemagglutinin__InfluenzaB__AFJ90450

SEQ ID NO: 26816 - protein, 584 aa, Artificial Sequence; identical to SEQ ID NO: 26426
  hemagglutinin__InfluenzaB__AFJ91038

SEQ ID NO: 26817 - protein, 584 aa, Artificial Sequence
  hemagglutinin__InfluenzaB__AFJ91049
MKAIIVLLMVVTSNADRICTGITSSNSPHVVKTATQGEVNVTGVIPLTITPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26818 - protein, 585 aa, Artificial Sequence
  hemagglutinin__InfluenzaB__AFJ91060
MKAIIVLLMVVTSNADRICTGITSSNSPHVVKTATQGEVNVTGVIPLTTTPTKSHFANLKGTETRGKLCPRCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26819 - protein, 584 aa, Artificial Sequence; identical to SEQ ID NO: 26426
  hemagglutinin__InfluenzaB__AFJ91071

SEQ ID NO: 26820 - protein, 584 aa, Artificial Sequence
  hemagglutinin__InfluenzaB__AFJ91082
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26821 - protein, 584 aa, Artificial Sequence; identical to SEQ ID NO: 26820
  hemagglutinin__InfluenzaB__AFJ91093

SEQ ID NO: 26822 - protein, 584 aa, Artificial Sequence; identical to SEQ ID NO: 26820
  hemagglutinin__InfluenzaB__AFJ91104

SEQ ID NO: 26823 - protein, 584 aa, Artificial Sequence; identical to SEQ ID NO: 26820
  hemagglutinin__InfluenzaB__AFJ91115

SEQ ID NO: 26824 - protein, 585 aa, Artificial Sequence
  hemagglutinin__InfluenzaB__AFJ91704
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGKGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26825 - protein, 584 aa, Artificial Sequence
  hemagglutinin__InfluenzaB__AFK09797
MKAIIVLLMVVTSNADRICTGITSSNSPHVVKTATQGEVNVTGVIPLTTTPIKSYFANLKGTKTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYVCTEGEDQITVWGFHSDNKNQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26826 - protein, 584 aa, Artificial Sequence; identical to SEQ ID NO: 26820
  hemagglutinin__InfluenzaB__AFN54654

SEQ ID NO: 26827 - protein, 584 aa, Artificial Sequence; identical to SEQ ID NO: 26567
  hemagglutinin__InfluenzaB__AFN54665

SEQ ID NO: 26828 - protein, 584 aa, Artificial Sequence; identical to SEQ ID NO: 26567
  hemagglutinin__InfluenzaB__AFN54676

SEQ ID NO: 26829 - protein, 584 aa, Artificial Sequence; identical to SEQ ID NO: 26820
  hemagglutinin__InfluenzaB__AFN54687

SEQ ID NO: 26830 - protein, 584 aa, Artificial Sequence
  hemagglutinin__InfluenzaB__AFN54698
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSFANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26831 - protein, 584 aa, Artificial Sequence; identical to SEQ ID NO: 26820
  hemagglutinin__InfluenzaB__AFN54709

SEQ ID NO: 26832 - protein, 584 aa, Artificial Sequence; identical to SEQ ID NO: 26820
  hemagglutinin__InfluenzaB__AFN54720

SEQ ID NO: 26833 - protein, 584 aa, Artificial Sequence; identical to SEQ ID NO: 26820
  hemagglutinin__InfluenzaB__AFN54731

SEQ ID NO: 26834 - protein, 584 aa, Artificial Sequence; identical to SEQ ID NO: 26820
  hemagglutinin__InfluenzaB__AFN54742

SEQ ID NO: 26835 - protein, 584 aa, Artificial Sequence; identical to SEQ ID NO: 26820
  hemagglutinin__InfluenzaB__AFN54753

SEQ ID NO: 26836 - protein, 584 aa, Artificial Sequence; identical to SEQ ID NO: 26820
  hemagglutinin__InfluenzaB__AFN54764

SEQ ID NO: 26837 - protein, 584 aa, Artificial Sequence; identical to SEQ ID NO: 26820
  hemagglutinin__InfluenzaB__AFN54775

SEQ ID NO: 26838 - protein, 584 aa, Artificial Sequence; identical to SEQ ID NO: 26820
  hemagglutinin__InfluenzaB__AFN54786

SEQ ID NO: 26839 - protein, 584 aa, Artificial Sequence; identical to SEQ ID NO: 26820
  hemagglutinin__InfluenzaB__AFN54797

SEQ ID NO: 26840 - protein, 584 aa, Artificial Sequence; identical to SEQ ID NO: 26820
  hemagglutinin__InfluenzaB__AFN54808

SEQ ID NO: 26841 - protein, 584 aa, Artificial Sequence; identical to SEQ ID NO: 26567
  hemagglutinin__InfluenzaB__AFN54819

SEQ ID NO: 26842 - protein, 584 aa, Artificial Sequence; identical to SEQ ID NO: 26820
  hemagglutinin__InfluenzaB__AFN54830

SEQ ID NO: 26843 - protein, 584 aa, Artificial Sequence; identical to SEQ ID NO: 26820
  hemagglutinin__InfluenzaB__AFN54841

SEQ ID NO: 26844 - protein, 584 aa, Artificial Sequence; identical to SEQ ID NO: 26820
  hemagglutinin__InfluenzaB__AFN54852

SEQ ID NO: 26845 - protein, 584 aa, Artificial Sequence; identical to SEQ ID NO: 26820
  hemagglutinin__InfluenzaB__AFN54863

SEQ ID NO: 26846 - protein, 585 aa, Artificial Sequence
  hemagglutinin__InfluenzaB__AFU34595
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYRDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPTKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26847 - protein, 585 aa, Artificial Sequence
  hemagglutinin__InfluenzaB__AFU34606
MKAIIVLLMVVTSNADRICTGITSSNSPHVVKTATQGEVNVTGVIPLTTTPTKSHFANLKGTETRGKLCPKCPNCTDLDVALDRPKCTGKIPSARVSILHEVRLVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDDETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26848 - protein, 585 aa, Artificial Sequence; identical to SEQ ID NO: 26756
  hemagglutinin__InfluenzaB__AFU34617

SEQ ID NO: 26849 - protein, 585 aa, Artificial Sequence
  hemagglutinin__InfluenzaB__AFU34628
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDDETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFLGAIAGFLEGGWKGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26850 - protein, 585 aa, Artificial Sequence; identical to SEQ ID NO: 26608
  hemagglutinin__InfluenzaB__AFU34639

SEQ ID NO: 26851 - protein, 585 aa, Artificial Sequence; identical to SEQ ID NO: 26645
  hemagglutinin__InfluenzaB__AGB08299

SEQ ID NO: 26852 - protein, 585 aa, Artificial Sequence; identical to SEQ ID NO: 26645
  hemagglutinin__InfluenzaB__AGB08300

SEQ ID NO: 26853 - protein, 584 aa, Artificial Sequence
  hemagglutinin__InfluenzaB__AGB97259
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYIVSRDNVSCSICL

SEQ ID NO: 26854 - protein, 584 aa, Artificial Sequence
  hemagglutinin__InfluenzaB__AGB97265
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26855 - protein, 584 aa, Artificial Sequence; identical to SEQ ID NO: 26854
  hemagglutinin__InfluenzaB__AGF44878

SEQ ID NO: 26856 - protein, 584 aa, Artificial Sequence; identical to SEQ ID NO: 26854
  hemagglutinin__InfluenzaB__AGF44879

SEQ ID NO: 26857 - protein, 584 aa, Artificial Sequence
  hemagglutinin__InfluenzaB__AGF44881
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQIAVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVILMLAIFIVYMVSRDNVSCSICL

SEQ ID NO: 26858 - protein, 584 aa, Artificial Sequence
  hemagglutinin__InfluenzaB__AGF44882
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGKSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26859 - protein, 584 aa, Artificial Sequence; identical to SEQ ID NO: 26854
  hemagglutinin__InfluenzaB__AGF44883

SEQ ID NO: 26860 - protein, 584 aa, Artificial Sequence; identical to SEQ ID NO: 26854
  hemagglutinin__InfluenzaB__AGF44884

SEQ ID NO: 26861 - protein, 584 aa, Artificial Sequence; identical to SEQ ID NO: 26854
  hemagglutinin__InfluenzaB__AGF44886

SEQ ID NO: 26862 - protein, 584 aa, Artificial Sequence; identical to SEQ ID NO: 26854
  hemagglutinin__InfluenzaB__AGF44887

SEQ ID NO: 26863 - protein, 584 aa, Artificial Sequence; identical to SEQ ID NO: 26854
  hemagglutinin__InfluenzaB__AGF44888

SEQ ID NO: 26864 - protein, 584 aa, Artificial Sequence
  hemagglutinin__InfluenzaB__AGL09834
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQIAVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGDFSLPTFDSLNITAASLNDDGLDNHTILLYYSTAASSLAVTLMLAIFIVYMVSRDNVSCSICL

SEQ ID NO: 26865 - protein, 584 aa, Artificial Sequence; identical to SEQ ID NO: 26854
  hemagglutinin__InfluenzaB__AGL09835

SEQ ID NO: 26866 - protein, 584 aa, Artificial Sequence
  hemagglutinin__InfluenzaB__AGL09836
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAKKAPGGPYRLGTSGSCPNATSKSGFFATMAWAVPEDNNKNATNPLTVEVPYICAEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26867 - protein, 584 aa, Artificial Sequence; identical to SEQ ID NO: 26854
  hemagglutinin__InfluenzaB__AGL09837

SEQ ID NO: 26868 - protein, 584 aa, Artificial Sequence; identical to SEQ ID NO: 26854
  hemagglutinin__InfluenzaB__AGL09838

SEQ ID NO: 26869 - protein, 584 aa, Artificial Sequence; identical to SEQ ID NO: 26854
  hemagglutinin__InfluenzaB__AGL09839

SEQ ID NO: 26870 - protein, 584 aa, Artificial Sequence; identical to SEQ ID NO: 26854
  hemagglutinin__InfluenzaB__AGL09840

SEQ ID NO: 26871 - protein, 584 aa, Artificial Sequence; identical to SEQ ID NO: 26854
  hemagglutinin__InfluenzaB__AGL09841

SEQ ID NO: 26872 - protein, 585 aa, Artificial Sequence
  hemagglutinin__InfluenzaB__AGL09842
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTETNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26873 - protein, 584 aa, Artificial Sequence; identical to SEQ ID NO: 26854
  hemagglutinin__InfluenzaB__AGL09843

SEQ ID NO: 26874 - protein, 584 aa, Artificial Sequence
  hemagglutinin__InfluenzaB__AGL09844
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQIGGFPDQKEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26875 - protein, 584 aa, Artificial Sequence; identical to SEQ ID NO: 26854
  hemagglutinin__InfluenzaB__AGL09845

SEQ ID NO: 26876 - protein, 584 aa, Artificial Sequence; identical to SEQ ID NO: 26854
  hemagglutinin__InfluenzaB__AGL09846

SEQ ID NO: 26877 - protein, 584 aa, Artificial Sequence
  hemagglutinin__InfluenzaB__AGL09847
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQIAIWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26878 - protein, 584 aa, Artificial Sequence
  hemagglutinin__InfluenzaB__AGL09849
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVINAEKAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26879 - protein, 584 aa, Artificial Sequence; identical to SEQ ID NO: 26854
  hemagglutinin__InfluenzaB__AGL09850

SEQ ID NO: 26880 - protein, 584 aa, Artificial Sequence; identical to SEQ ID NO: 26854
  hemagglutinin__InfluenzaB__AGL09851

SEQ ID NO: 26881 - protein, 585 aa, Artificial Sequence; identical to SEQ ID NO: 26645
  hemagglutinin__InfluenzaB__AGL09852

SEQ ID NO: 26882 - protein, 584 aa, Artificial Sequence; identical to SEQ ID NO: 26854
  hemagglutinin__InfluenzaB__AGL09853

SEQ ID NO: 26883 - protein, 584 aa, Artificial Sequence; identical to SEQ ID NO: 26854
  hemagglutinin__InfluenzaB__AGL09854

SEQ ID NO: 26884 - protein, 585 aa, Artificial Sequence
  hemagglutinin__InfluenzaB__AGL09855
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTETNPLTIEVPYICTEEEDQITVWGFHSDNETQMAKLYGDSKPQKFTSSANGVTTHYVSQIGDFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26885 - protein, 584 aa, Artificial Sequence; identical to SEQ ID NO: 26854
  hemagglutinin__InfluenzaB__AGL09856

SEQ ID NO: 26886 - protein, 584 aa, Artificial Sequence
  hemagglutinin__InfluenzaB__AGL09857
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQKVIDAEKAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQIGGFPDQTEDGGLPQSGRIVVDYMIQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26887 - protein, 585 aa, Artificial Sequence
  hemagglutinin__InfluenzaB__AGL09859
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAEDAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26888 - protein, 585 aa, Artificial Sequence; identical to SEQ ID NO: 26887
  hemagglutinin__InfluenzaB__AGL09860

SEQ ID NO: 26889 - protein, 585 aa, Artificial Sequence; identical to SEQ ID NO: 26887
  hemagglutinin__InfluenzaB__AGL09861

SEQ ID NO: 26890 - protein, 585 aa, Artificial Sequence; identical to SEQ ID NO: 26887
  hemagglutinin__InfluenzaB__AGL09862

SEQ ID NO: 26891 - protein, 585 aa, Artificial Sequence; identical to SEQ ID NO: 26887
  hemagglutinin__InfluenzaB__AGL09863

SEQ ID NO: 26892 - protein, 584 aa, Artificial Sequence; identical to SEQ ID NO: 26854
  hemagglutinin__InfluenzaB__AGL09864

SEQ ID NO: 26893 - protein, 584 aa, Artificial Sequence; identical to SEQ ID NO: 26854
  hemagglutinin__InfluenzaB__AGL09866

SEQ ID NO: 26894 - protein, 584 aa, Artificial Sequence; identical to SEQ ID NO: 26854
  hemagglutinin__InfluenzaB__AGL09867

SEQ ID NO: 26895 - protein, 584 aa, Artificial Sequence; identical to SEQ ID NO: 26854
  hemagglutinin__InfluenzaB__AGL09868

SEQ ID NO: 26896 - protein, 584 aa, Artificial Sequence
  hemagglutinin__InfluenzaB__AGL09869
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNTTSKSGFFATMAWAVPKDNNKNATNPLTVEVPYICAEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26897 - protein, 584 aa, Artificial Sequence
  hemagglutinin__InfluenzaB__AGL09870
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQITVWGFHSDNKTQMKNLYGDSNPQRFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26898 - protein, 584 aa, Artificial Sequence; identical to SEQ ID NO: 26854
  hemagglutinin__InfluenzaB__AGL09871

SEQ ID NO: 26899 - protein, 584 aa, Artificial Sequence
  hemagglutinin__InfluenzaB__AGL09872
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQIAVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26900 - protein, 584 aa, Artificial Sequence; identical to SEQ ID NO: 26854
  hemagglutinin__InfluenzaB__AGL09873

SEQ ID NO: 26901 - protein, 585 aa, Artificial Sequence; identical to SEQ ID NO: 26887
  hemagglutinin__InfluenzaB__AGL09874

SEQ ID NO: 26902 - protein, 585 aa, Artificial Sequence; identical to SEQ ID NO: 26872
  hemagglutinin__InfluenzaB__AGO02695

SEQ ID NO: 26903 - protein, 584 aa, Artificial Sequence; identical to SEQ ID NO: 26854
  hemagglutinin__InfluenzaB__AGQ16249

SEQ ID NO: 26904 - protein, 585 aa, Artificial Sequence; identical to SEQ ID NO: 26887
  hemagglutinin__InfluenzaB__AGQ16250

SEQ ID NO: 26905 - protein, 585 aa, Artificial Sequence; identical to SEQ ID NO: 26887
  hemagglutinin__InfluenzaB__AGQ16251

SEQ ID NO: 26906 - protein, 584 aa, Artificial Sequence
  hemagglutinin__InfluenzaB__AGQ16252
MKAIIVLLMVVTSNADRICTGITSSNSPHVVKTATQGEVNVTGVIPLTTTPAKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICKEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26907 - protein, 584 aa, Artificial Sequence; identical to SEQ ID NO: 26854
  hemagglutinin__InfluenzaB__AGQ16253

SEQ ID NO: 26908 - protein, 584 aa, Artificial Sequence
  hemagglutinin__InfluenzaB__AGQ16255
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQITVWGFHSDNKTQMKNLYGDSNPQKFTSSANGITTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHIILLYYSTAASSLAVTLMLAIFIVYMVSRDNVSCSICL

SEQ ID NO: 26909 - protein, 584 aa, Artificial Sequence
  hemagglutinin__InfluenzaB__AGQ16256
MKAIIVLLMVVTSNADRICTGITSSNSPHVVKTVTQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDSNKNATNPLTVEVPYICAEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26910 - protein, 584 aa, Artificial Sequence; identical to SEQ ID NO: 26854
  hemagglutinin__InfluenzaB__AGQ16257

SEQ ID NO: 26911 - protein, 584 aa, Artificial Sequence; identical to SEQ ID NO: 26854
  hemagglutinin__InfluenzaB__AGQ16258

SEQ ID NO: 26912 - protein, 584 aa, Artificial Sequence; identical to SEQ ID NO: 26854
  hemagglutinin__InfluenzaB__AGQ16259

SEQ ID NO: 26913 - protein, 584 aa, Artificial Sequence
  hemagglutinin__InfluenzaB__AGQ16260
MKTIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSSQNVIDAEKAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26914 - protein, 584 aa, Artificial Sequence; identical to SEQ ID NO: 26854
  hemagglutinin__InfluenzaB__AGQ16261

SEQ ID NO: 26915 - protein, 584 aa, Artificial Sequence; identical to SEQ ID NO: 26854
  hemagglutinin__InfluenzaB__AGQ16262

SEQ ID NO: 26916 - protein, 585 aa, Artificial Sequence; identical to SEQ ID NO: 26887
  hemagglutinin__InfluenzaB__AGQ16263

SEQ ID NO: 26917 - protein, 585 aa, Artificial Sequence; identical to SEQ ID NO: 26887
  hemagglutinin__InfluenzaB__AGQ16264

SEQ ID NO: 26918 - protein, 584 aa, Artificial Sequence; identical to SEQ ID NO: 26899
  hemagglutinin__InfluenzaB__AGQ16265

SEQ ID NO: 26919 - protein, 584 aa, Artificial Sequence
  hemagglutinin__InfluenzaB__AGQ16266
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQVGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26920 - protein, 584 aa, Artificial Sequence; identical to SEQ ID NO: 26899
  hemagglutinin__InfluenzaB__AGQ16267

SEQ ID NO: 26921 - protein, 584 aa, Artificial Sequence; identical to SEQ ID NO: 26899
  hemagglutinin__InfluenzaB__AGQ16268

SEQ ID NO: 26922 - protein, 585 aa, Artificial Sequence; identical to SEQ ID NO: 26872
  hemagglutinin__InfluenzaB__AGQ16269

SEQ ID NO: 26923 - protein, 584 aa, Artificial Sequence; identical to SEQ ID NO: 26899
  hemagglutinin__InfluenzaB__AGQ16270

SEQ ID NO: 26924 - protein, 584 aa, Artificial Sequence
  hemagglutinin__InfluenzaB__AGQ16272
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPRDNNKNATNPLTVEVPYICEEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26925 - protein, 584 aa, Artificial Sequence; identical to SEQ ID NO: 26854
  hemagglutinin__InfluenzaB__AGQ16273

SEQ ID NO: 26926 - protein, 584 aa, Artificial Sequence; identical to SEQ ID NO: 26854
  hemagglutinin__InfluenzaB__AGQ16274

SEQ ID NO: 26927 - protein, 584 aa, Artificial Sequence; identical to SEQ ID NO: 26854
  hemagglutinin__InfluenzaB__AGQ16275

SEQ ID NO: 26928 - protein, 584 aa, Artificial Sequence; identical to SEQ ID NO: 26854
  hemagglutinin__InfluenzaB__AGQ16276

SEQ ID NO: 26929 - protein, 584 aa, Artificial Sequence; identical to SEQ ID NO: 26899
  hemagglutinin__InfluenzaB__AGQ16277

SEQ ID NO: 26930 - protein, 584 aa, Artificial Sequence; identical to SEQ ID NO: 26899
  hemagglutinin__InfluenzaB__AGQ16278

SEQ ID NO: 26931 - protein, 584 aa, Artificial Sequence; identical to SEQ ID NO: 26899
  hemagglutinin__InfluenzaB__AGQ16279

SEQ ID NO: 26932 - protein, 584 aa, Artificial Sequence; identical to SEQ ID NO: 26899
  hemagglutinin__InfluenzaB__AGQ16280

SEQ ID NO: 26933 - protein, 584 aa, Artificial Sequence
  hemagglutinin__InfluenzaB__AGQ16281
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQIGSFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26934 - protein, 584 aa, Artificial Sequence
  hemagglutinin__InfluenzaB__AGQ16282
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKGNNKNATNPLTVEVPYICAEGEDQITVWGFHSDNKTQMKNLYGDSNPQRFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26935 - protein, 584 aa, Artificial Sequence
  hemagglutinin__InfluenzaB__AGQ16283
MKAIIVLLMVVTSNADRICTGITSSNSPHVVKTATHGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQIAVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26936 - protein, 585 aa, Artificial Sequence
  hemagglutinin__InfluenzaB__AGQ16284
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEARPVTSGCFPIMHDRTKIRQLPNLLRGYEHIKLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26937 - protein, 584 aa, Artificial Sequence; identical to SEQ ID NO: 26899
  hemagglutinin__InfluenzaB__AGQ16285

SEQ ID NO: 26938 - protein, 584 aa, Artificial Sequence; identical to SEQ ID NO: 26899
  hemagglutinin__InfluenzaB__AGQ16286

SEQ ID NO: 26939 - protein, 584 aa, Artificial Sequence
  hemagglutinin__InfluenzaB__AGQ16287
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICEEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26940 - protein, 584 aa, Artificial Sequence; identical to SEQ ID NO: 26854
  hemagglutinin__InfluenzaB__AGQ16289

SEQ ID NO: 26941 - protein, 584 aa, Artificial Sequence; identical to SEQ ID NO: 26854
  hemagglutinin__InfluenzaB__AGQ16290

SEQ ID NO: 26942 - protein, 584 aa, Artificial Sequence
  hemagglutinin__InfluenzaB__AGQ16291
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNTTSKSGFFATMAWAVPKDNNKNATNPLTVEVPYICAEGEDQIAVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26943 - protein, 584 aa, Artificial Sequence
  hemagglutinin__InfluenzaB__AGQ16292
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQIAVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEIKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26944 - protein, 584 aa, Artificial Sequence; identical to SEQ ID NO: 26943
  hemagglutinin__InfluenzaB__AGQ16293

SEQ ID NO: 26945 - protein, 584 aa, Artificial Sequence; identical to SEQ ID NO: 26943
  hemagglutinin__InfluenzaB__AGQ16294

SEQ ID NO: 26946 - protein, 585 aa, Artificial Sequence
  hemagglutinin__InfluenzaB__AGQ16295
MKAIIVLLMVVTSNADRICTGITSSNSPHVVKTATQGEVNVTGAIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTETNPLTIEVPYICTEEEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26947 - protein, 585 aa, Artificial Sequence; identical to SEQ ID NO: 26887
  hemagglutinin__InfluenzaB__AGQ16296

SEQ ID NO: 26948 - protein, 584 aa, Artificial Sequence; identical to SEQ ID NO: 26854
  hemagglutinin__InfluenzaB__AGQ16297

SEQ ID NO: 26949 - protein, 584 aa, Artificial Sequence
  hemagglutinin__InfluenzaB__AGQ16298
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAIAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26950 - protein, 584 aa, Artificial Sequence; identical to SEQ ID NO: 26899
  hemagglutinin__InfluenzaB__AGQ16299

SEQ ID NO: 26951 - protein, 584 aa, Artificial Sequence; identical to SEQ ID NO: 26899
  hemagglutinin__InfluenzaB__AGQ16300

SEQ ID NO: 26952 - protein, 584 aa, Artificial Sequence; identical to SEQ ID NO: 26854
  hemagglutinin__InfluenzaB__AGQ16301

SEQ ID NO: 26953 - protein, 584 aa, Artificial Sequence; identical to SEQ ID NO: 26854
  hemagglutinin__InfluenzaB__AGQ16302

SEQ ID NO: 26954 - protein, 584 aa, Artificial Sequence; identical to SEQ ID NO: 26854
  hemagglutinin__InfluenzaB__AGQ16303

SEQ ID NO: 26955 - protein, 584 aa, Artificial Sequence; identical to SEQ ID NO: 26854
  hemagglutinin__InfluenzaB__AGQ16305

SEQ ID NO: 26956 - protein, 585 aa, Artificial Sequence
  hemagglutinin__InfluenzaB__AGQ16306
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTETNPLTIEVPYICKEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26957 - protein, 584 aa, Artificial Sequence; identical to SEQ ID NO: 26854
  hemagglutinin__InfluenzaB__AGQ16307

SEQ ID NO: 26958 - protein, 585 aa, Artificial Sequence; identical to SEQ ID NO: 26887
  hemagglutinin__InfluenzaB__AGQ16308

SEQ ID NO: 26959 - protein, 584 aa, Artificial Sequence
  hemagglutinin__InfluenzaB__AGQ16309
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQIGGFPDQTEDGGLPQSGRIVADYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26960 - protein, 584 aa, Artificial Sequence
  hemagglutinin__InfluenzaB__AGQ16310
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMVAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26961 - protein, 585 aa, Artificial Sequence; identical to SEQ ID NO: 26887
  hemagglutinin__InfluenzaB__AGQ16311

SEQ ID NO: 26962 - protein, 584 aa, Artificial Sequence; identical to SEQ ID NO: 26854
  hemagglutinin__InfluenzaB__AGQ16312

SEQ ID NO: 26963 - protein, 584 aa, Artificial Sequence
  hemagglutinin__InfluenzaB__AGQ16313
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQIAVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKEKGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26964 - protein, 585 aa, Artificial Sequence
  hemagglutinin__InfluenzaB__AGQ16314
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTETNPLTIEVPYICTEEEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26965 - protein, 584 aa, Artificial Sequence
  hemagglutinin__InfluenzaB__AGQ16315
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQTVIDAEKAPGGPYRLGTSGSCPNATSKSGFFATMAWAVPKDNNKNATNPLTVEVPYICAEGEDQITVWGFHSDNKTQMKNLYGDSNPQKFTSSANGITTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHIILLYYSTAASSLAVTLMLAIFIVYMVSRDNVSCSICL

SEQ ID NO: 26966 - protein, 584 aa, Artificial Sequence; identical to SEQ ID NO: 26854
  hemagglutinin__InfluenzaB__AGQ16316

SEQ ID NO: 26967 - protein, 584 aa, Artificial Sequence; identical to SEQ ID NO: 26854
  hemagglutinin__InfluenzaB__AGQ16317

SEQ ID NO: 26968 - protein, 585 aa, Artificial Sequence; identical to SEQ ID NO: 26645
  hemagglutinin__InfluenzaB__AGQ16318

SEQ ID NO: 26969 - protein, 584 aa, Artificial Sequence
  hemagglutinin__InfluenzaB__AGQ16319
MKAIIVLLMVVTSNADRICTGITSSNSPHVVKTATQGEVNVTGVIPLTTTPTKSYFANLKGTKTRGKLCPGCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQIAVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 26970 - protein, 584 aa, Artificial Sequence; identical to SEQ ID NO: 26899
  hemagglutinin__InfluenzaB__AGQ16320

SEQ ID NO: 26971 - protein, 584 aa, Artificial Sequence; identical to SEQ ID NO: 26854
  hemagglutinin__InfluenzaB__AGQ16321

SEQ ID NO: 26972 - protein, 584 aa, Artificial Sequence; identical to SEQ ID NO: 26854
  hemagglutinin__InfluenzaB__AGQ16322

SEQ ID NO: 26973 - protein, 585 aa, Artificial Sequence
  hemagglutinin__InfluenzaB__AGQ16323
MKAIIVLLMVVTSNADRICTGITSSNSPHVVKTATQGEVNVTGVIPLTTTPTKSHFASLKGTETRGKLCPKCLNCTDLDVALGRPKCTGKIPSARVSILHEVRPVTSGCFPIMHDRTKIRQLPNLLRGYEHIRLSTHNVINAEDAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26974 - protein, 584 aa, Artificial Sequence; identical to SEQ ID NO: 26854
  hemagglutinin__InfluenzaB__AGQ16324

SEQ ID NO: 26975 - protein, 584 aa, Artificial Sequence; identical to SEQ ID NO: 26854
  hemagglutinin__InfluenzaB__AGQ16325

SEQ ID NO: 26976 - protein, 584 aa, Artificial Sequence; identical to SEQ ID NO: 26854
  hemagglutinin__InfluenzaB__AGQ16326

SEQ ID NO: 26977 - protein, 584 aa, Artificial Sequence; identical to SEQ ID NO: 26854
  hemagglutinin__InfluenzaB__AGQ16327

SEQ ID NO: 26978 - protein, 585 aa, Artificial Sequence
  hemagglutinin__InfluenzaB__AGQ16328
MKAIIVLLMVVTSNADRICTGITSSNSPHVVKTATQGEVNVTGVIPLTTTPTKSHFANLKGTETRGKLCPKCLNCTDLDVALGRPKCTGKTPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSNPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26979 - protein, 585 aa, Artificial Sequence
  hemagglutinin__InfluenzaB__AGX15487
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26980 - protein, 585 aa, Artificial Sequence; identical to SEQ ID NO: 26979
  hemagglutinin__InfluenzaB__AGX15496

SEQ ID NO: 26981 - protein, 585 aa, Artificial Sequence
  hemagglutinin__InfluenzaB__AGX15518
MKAIIVLLMVVTSNADRICTGITSSNSPHVVKTATQGEVNVTGVIPLTTAPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDNETQMAKLYGDSKPQKFTSSANGVTTHYVSQIGGFPNQTEDGGLPQSGRIVVDYMVQKPGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSSAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26982 - protein, 585 aa, Artificial Sequence
  hemagglutinin__InfluenzaB__AGX15529
MKAIIVLLMVVTSNADRVCTGITSSNSPHVVKTATQGEVNVTGVIPLTTTPTKSHFANLKGTKTRGKLCPKCLNCTDLDVALGRPKCTGNIPSAEVSILYEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGTLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26983 - protein, 585 aa, Artificial Sequence; identical to SEQ ID NO: 26573
  hemagglutinin__InfluenzaB__AGX15541

SEQ ID NO: 26984 - protein, 585 aa, Artificial Sequence
  hemagglutinin__InfluenzaB__AGX15552
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAKNAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26985 - protein, 585 aa, Artificial Sequence; identical to SEQ ID NO: 26582
  hemagglutinin__InfluenzaB__AGX15563

SEQ ID NO: 26986 - protein, 585 aa, Artificial Sequence; identical to SEQ ID NO: 26582
  hemagglutinin__InfluenzaB__AGX15574

SEQ ID NO: 26987 - protein, 585 aa, Artificial Sequence
  hemagglutinin__InfluenzaB__AGX15607
MKAIIVLLMVVTSNADRICTGITSSNSPHVVKTATQGEVNVTGVIPLTTTPTKSHFANLKGTETRGKLCPKCLNCTDLDVALGRPKCTGNTPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26988 - protein, 585 aa, Artificial Sequence
  hemagglutinin__InfluenzaB__AGX15629
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNEIQMAKLYGDSKPQKFTSSANGVTTHYVSQIGGFPNQTEDGGLPQSGRIVVDYMVQKSGKTGTITYQRGILLPQKVWCTSGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26989 - protein, 585 aa, Artificial Sequence
  hemagglutinin__InfluenzaB__AGX15651
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26990 - protein, 585 aa, Artificial Sequence; identical to SEQ ID NO: 26989
  hemagglutinin__InfluenzaB__AGX15675

SEQ ID NO: 26991 - protein, 585 aa, Artificial Sequence; identical to SEQ ID NO: 26989
  hemagglutinin__InfluenzaB__AGX15686

SEQ ID NO: 26992 - protein, 585 aa, Artificial Sequence
  hemagglutinin__InfluenzaB__AGX15697
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNENQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 26993 - protein, 585 aa, Artificial Sequence; identical to SEQ ID NO: 26989
  hemagglutinin__InfluenzaB__AGX15708

SEQ ID NO: 26994 - protein, 585 aa, Artificial Sequence; identical to SEQ ID NO: 26989
  hemagglutinin__InfluenzaB__AGX15719

SEQ ID NO: 26995 - protein, 585 aa, Artificial Sequence; identical to SEQ ID NO: 26514
  hemagglutinin__InfluenzaB__AGX15730

SEQ ID NO: 26996 - protein, 585 aa, Artificial Sequence; identical to SEQ ID NO: 26989
  hemagglutinin__InfluenzaB__AGX15741

SEQ ID NO: 26997 - protein, 585 aa, Artificial Sequence; identical to SEQ ID NO: 26989
  hemagglutinin__InfluenzaB__AGX15753

SEQ ID NO: 26998 - protein, 585 aa, Artificial Sequence
  hemagglutinin__InfluenzaB__AGX15764
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAITLMIAIFVVYMVSRDNVSCSICL

SEQ ID NO: 26999 - protein, 584 aa, Artificial Sequence
  hemagglutinin__InfluenzaB__AGX15775
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKIQMKNLYGDSNPQKFTSSANGVTTHYVSQIGSFPDQTEDGGLPQSGRIVVDYMMQKPGKTGTIVYQRGVLLPQRVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27000 - protein, 585 aa, Artificial Sequence
  hemagglutinin__InfluenzaB__AGX15786
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFFLPTFDSLNITAASLNDDGLDNHTILLYYSTAASSLAVTLMIAIFVVYMVSRDNVSCSICL

SEQ ID NO: 27001 - protein, 585 aa, Artificial Sequence; identical to SEQ ID NO: 26989
  hemagglutinin__InfluenzaB__AGX15797

SEQ ID NO: 27002 - protein, 585 aa, Artificial Sequence
  hemagglutinin__InfluenzaB__AGX15808
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCAIGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27003 - protein, 585 aa, Artificial Sequence; identical to SEQ ID NO: 26608
  hemagglutinin__InfluenzaB__AGX15830

SEQ ID NO: 27004 - protein, 585 aa, Artificial Sequence; identical to SEQ ID NO: 26608
  hemagglutinin__InfluenzaB__AGX15841

SEQ ID NO: 27005 - protein, 585 aa, Artificial Sequence; identical to SEQ ID NO: 26608
  hemagglutinin__InfluenzaB__AGX15852

SEQ ID NO: 27006 - protein, 585 aa, Artificial Sequence; identical to SEQ ID NO: 26608
  hemagglutinin__InfluenzaB__AGX15863

SEQ ID NO: 27007 - protein, 585 aa, Artificial Sequence
  hemagglutinin__InfluenzaB__AGX15874
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLNNHTILLYYSTAASSLAVTLMIAIFVVYMVSRDNVSCSICL

SEQ ID NO: 27008 - protein, 585 aa, Artificial Sequence; identical to SEQ ID NO: 26608
  hemagglutinin__InfluenzaB__AGX15885

SEQ ID NO: 27009 - protein, 585 aa, Artificial Sequence
  hemagglutinin__InfluenzaB__AGX15896
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTAHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHGEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27010 - protein, 585 aa, Artificial Sequence; identical to SEQ ID NO: 26608
  hemagglutinin__InfluenzaB__AGX15907

SEQ ID NO: 27011 - protein, 585 aa, Artificial Sequence; identical to SEQ ID NO: 26608
  hemagglutinin__InfluenzaB__AGX15918

SEQ ID NO: 27012 - protein, 585 aa, Artificial Sequence
  hemagglutinin__InfluenzaB__AGX15929
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTNNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSEKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27013 - protein, 585 aa, Artificial Sequence; identical to SEQ ID NO: 26608
  hemagglutinin__InfluenzaB__AGX15940

SEQ ID NO: 27014 - protein, 585 aa, Artificial Sequence
  hemagglutinin__InfluenzaB__AGX15962
MKAIIVLLMVVTSNADRICTGITSSNSPHIVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMMQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27015 - protein, 585 aa, Artificial Sequence; identical to SEQ ID NO: 26645
  hemagglutinin__InfluenzaB__AGX15973

SEQ ID NO: 27016 - protein, 585 aa, Artificial Sequence; identical to SEQ ID NO: 26645
  hemagglutinin__InfluenzaB__AGX15984

SEQ ID NO: 27017 - protein, 585 aa, Artificial Sequence; identical to SEQ ID NO: 26683
  hemagglutinin__InfluenzaB__AGX15995

SEQ ID NO: 27018 - protein, 585 aa, Artificial Sequence; identical to SEQ ID NO: 26683
  hemagglutinin__InfluenzaB__AGX16006

SEQ ID NO: 27019 - protein, 585 aa, Artificial Sequence
  hemagglutinin__InfluenzaB__AGX16017
MKAIIVLLMVVTSNADRICTGITSSNSPHIVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNEIQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27020 - protein, 584 aa, Artificial Sequence; identical to SEQ ID NO: 26426
  hemagglutinin__InfluenzaB__AGX16028

SEQ ID NO: 27021 - protein, 584 aa, Artificial Sequence
  hemagglutinin__InfluenzaB__AGX16039
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAVDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27022 - protein, 584 aa, Artificial Sequence
  hemagglutinin__InfluenzaB__AGX16050
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAENAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPAQTEDGGLPQSGRIVVDYMVQKPRKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27023 - protein, 584 aa, Artificial Sequence
  hemagglutinin__InfluenzaB__AGX16061
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27024 - protein, 584 aa, Artificial Sequence
  hemagglutinin__InfluenzaB__AGX16083
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27025 - protein, 584 aa, Artificial Sequence
  hemagglutinin__InfluenzaB__AGX16105
MKAIIVLLMVVTSNADRICTGITSSSSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHSEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27026 - protein, 584 aa, Artificial Sequence
  hemagglutinin__InfluenzaB__AGX16116
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAENAPGGPYRLGTSGSCPNATSKSGFFATMAWAVPKDNNKNATNPLTVEVPYVCTEGEDQITVWGFHSDNKTQMKNLYGDSNPQKFTSSANGVTTHYVSQIGGFPAQTEDGGLPQSGRIVVDYMVQKPRKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEIKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27027 - protein, 584 aa, Artificial Sequence
  hemagglutinin__InfluenzaB__AGX16127
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAENAPGGPYRLGTSGSCPNATSKSGFFATMAWAVPKDNNKNATNPLTVEVPYVCTEGEDQITVWGFHSDNKIQMKNLYGDSNPQKFTSSANGVTTHYVSQIGGFPAQTEDGGLPQSGRIVVDYMVQKPRKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEIKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27028 - protein, 584 aa, Artificial Sequence; identical to SEQ ID NO: 27026
  hemagglutinin__InfluenzaB__AGX16138

SEQ ID NO: 27029 - protein, 584 aa, Artificial Sequence; identical to SEQ ID NO: 27023
  hemagglutinin__InfluenzaB__AGX16149

SEQ ID NO: 27030 - protein, 584 aa, Artificial Sequence; identical to SEQ ID NO: 27024
  hemagglutinin__InfluenzaB__AGX16160

SEQ ID NO: 27031 - protein, 584 aa, Artificial Sequence; identical to SEQ ID NO: 27024
  hemagglutinin__InfluenzaB__AGX16182

SEQ ID NO: 27032 - protein, 584 aa, Artificial Sequence; identical to SEQ ID NO: 26426
  hemagglutinin__InfluenzaB__AGX16193

SEQ ID NO: 27033 - protein, 584 aa, Artificial Sequence; identical to SEQ ID NO: 26426
  hemagglutinin__InfluenzaB__AGX16215

SEQ ID NO: 27034 - protein, 584 aa, Artificial Sequence; identical to SEQ ID NO: 26426
  hemagglutinin__InfluenzaB__AGX16226

SEQ ID NO: 27035 - protein, 584 aa, Artificial Sequence
  hemagglutinin__InfluenzaB__AGX16237
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAITLMLAIFIVYMVSRDNVSCSICL

SEQ ID NO: 27036 - protein, 584 aa, Artificial Sequence; identical to SEQ ID NO: 26426
  hemagglutinin__InfluenzaB__AGX16248

SEQ ID NO: 27037 - protein, 584 aa, Artificial Sequence; identical to SEQ ID NO: 26426
  hemagglutinin__InfluenzaB__AGX16259

SEQ ID NO: 27038 - protein, 584 aa, Artificial Sequence
  hemagglutinin__InfluenzaB__AGX16270
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICKEGEDQITVWGFHSDNKTQMKNLYGDSNPQKFTSSANGVTTHYVSQIGGFPDQTEDGGLPQSGRIVVDYMIQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27039 - protein, 584 aa, Artificial Sequence; identical to SEQ ID NO: 27038
  hemagglutinin__InfluenzaB__AGX16281

SEQ ID NO: 27040 - protein, 584 aa, Artificial Sequence
  hemagglutinin__InfluenzaB__AGX16292
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSNQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGALPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27041 - protein, 585 aa, Artificial Sequence; identical to SEQ ID NO: 26514
  hemagglutinin__InfluenzaB__AGX16303

SEQ ID NO: 27042 - protein, 584 aa, Artificial Sequence; identical to SEQ ID NO: 26426
  hemagglutinin__InfluenzaB__AGX16314

SEQ ID NO: 27043 - protein, 584 aa, Artificial Sequence; identical to SEQ ID NO: 26426
  hemagglutinin__InfluenzaB__AGX16325

SEQ ID NO: 27044 - protein, 584 aa, Artificial Sequence; identical to SEQ ID NO: 26731
  hemagglutinin__InfluenzaB__AGX16336

SEQ ID NO: 27045 - protein, 584 aa, Artificial Sequence; identical to SEQ ID NO: 26731
  hemagglutinin__InfluenzaB__AGX16347

SEQ ID NO: 27046 - protein, 584 aa, Artificial Sequence; identical to SEQ ID NO: 26731
  hemagglutinin__InfluenzaB__AGX16358

SEQ ID NO: 27047 - protein, 584 aa, Artificial Sequence
  hemagglutinin__InfluenzaB__AGX16369
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGSFPDQTEDGGLPQSGRIVVDYMMQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27048 - protein, 584 aa, Artificial Sequence
  hemagglutinin__InfluenzaB__AGX16380
MKAIVVLLMVVTSNADRICTGITSSNSPHVVKTATQGEVNVTGVIPLTTTPTKSYFANLKGTRTRGKLCPDCLNCTDLDVALGRPMCVGATPSAKASILHEVRPVTSGCFPMMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGSFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27049 - protein, 584 aa, Artificial Sequence; identical to SEQ ID NO: 26567
  hemagglutinin__InfluenzaB__AGX16391

SEQ ID NO: 27050 - protein, 584 aa, Artificial Sequence
  hemagglutinin__InfluenzaB__AGX16402
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKPQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27051 - protein, 584 aa, Artificial Sequence; identical to SEQ ID NO: 26820
  hemagglutinin__InfluenzaB__AGX16413

SEQ ID NO: 27052 - protein, 584 aa, Artificial Sequence; identical to SEQ ID NO: 26820
  hemagglutinin__InfluenzaB__AGX16423

SEQ ID NO: 27053 - protein, 584 aa, Artificial Sequence; identical to SEQ ID NO: 26820
  hemagglutinin__InfluenzaB__AGX16434

SEQ ID NO: 27054 - protein, 584 aa, Artificial Sequence; identical to SEQ ID NO: 26820
  hemagglutinin__InfluenzaB__AGX16445

SEQ ID NO: 27055 - protein, 584 aa, Artificial Sequence; identical to SEQ ID NO: 26820
  hemagglutinin__InfluenzaB__AGX16456

SEQ ID NO: 27056 - protein, 584 aa, Artificial Sequence
  hemagglutinin__InfluenzaB__AGX16467
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGSFPDQTEDGGLPQSGRIVVDYMMQKPGKTGTIVYQRGVLLPQRVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27057 - protein, 584 aa, Artificial Sequence; identical to SEQ ID NO: 26820
  hemagglutinin__InfluenzaB__AGX16478

SEQ ID NO: 27058 - protein, 584 aa, Artificial Sequence; identical to SEQ ID NO: 26567
  hemagglutinin__InfluenzaB__AGX16489

SEQ ID NO: 27059 - protein, 585 aa, Artificial Sequence; identical to SEQ ID NO: 26979
  hemagglutinin__InfluenzaB__AGX16500

SEQ ID NO: 27060 - protein, 585 aa, Artificial Sequence; identical to SEQ ID NO: 26979
  hemagglutinin__InfluenzaB__AGX16511

SEQ ID NO: 27061 - protein, 585 aa, Artificial Sequence; identical to SEQ ID NO: 26979
  hemagglutinin__InfluenzaB__AGX16522

SEQ ID NO: 27062 - protein, 585 aa, Artificial Sequence
  hemagglutinin__InfluenzaB__AGX16533
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDKETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27063 - protein, 585 aa, Artificial Sequence
  hemagglutinin__InfluenzaB__AGX16555
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27064 - protein, 585 aa, Artificial Sequence
  hemagglutinin__InfluenzaB__AGX16566
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNEIQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27065 - protein, 585 aa, Artificial Sequence; identical to SEQ ID NO: 26979
  hemagglutinin__InfluenzaB__AGX16577

SEQ ID NO: 27066 - protein, 585 aa, Artificial Sequence
  hemagglutinin__InfluenzaB__AGX16588
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNEIQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAIEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27067 - protein, 585 aa, Artificial Sequence; identical to SEQ ID NO: 26979
  hemagglutinin__InfluenzaB__AGX16599

SEQ ID NO: 27068 - protein, 585 aa, Artificial Sequence; identical to SEQ ID NO: 27062
  hemagglutinin__InfluenzaB__AGX16610

SEQ ID NO: 27069 - protein, 585 aa, Artificial Sequence; identical to SEQ ID NO: 26979
  hemagglutinin__InfluenzaB__AGX16621

SEQ ID NO: 27070 - protein, 585 aa, Artificial Sequence
  hemagglutinin__InfluenzaB__AGX16654
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTAINSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAIEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27071 - protein, 585 aa, Artificial Sequence; identical to SEQ ID NO: 26979
  hemagglutinin__InfluenzaB__AGX16665

SEQ ID NO: 27072 - protein, 585 aa, Artificial Sequence; identical to SEQ ID NO: 26979
  hemagglutinin__InfluenzaB__AGX16676

SEQ ID NO: 27073 - protein, 585 aa, Artificial Sequence; identical to SEQ ID NO: 26979
  hemagglutinin__InfluenzaB__AGX16687

SEQ ID NO: 27074 - protein, 585 aa, Artificial Sequence; identical to SEQ ID NO: 26979
  hemagglutinin__InfluenzaB__AGX16698

SEQ ID NO: 27075 - protein, 585 aa, Artificial Sequence
  hemagglutinin__InfluenzaB__AGX16709
MKAIIVLLMVVTSNADRICTGITSSNSPHVVKTATQGEVNVTGVIPLTTTPTKSHFANLKGTKTRGKLCPKCLNCTDLDVALGRPKCTENIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27076 - protein, 585 aa, Artificial Sequence; identical to SEQ ID NO: 26979
  hemagglutinin__InfluenzaB__AGX16720

SEQ ID NO: 27077 - protein, 585 aa, Artificial Sequence; identical to SEQ ID NO: 26979
  hemagglutinin__InfluenzaB__AGX16731

SEQ ID NO: 27078 - protein, 585 aa, Artificial Sequence
  hemagglutinin__InfluenzaB__AGX16742
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSIIHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27079 - protein, 585 aa, Artificial Sequence; identical to SEQ ID NO: 26979
  hemagglutinin__InfluenzaB__AGX16753

SEQ ID NO: 27080 - protein, 585 aa, Artificial Sequence; identical to SEQ ID NO: 26979
  hemagglutinin__InfluenzaB__AGX16764

SEQ ID NO: 27081 - protein, 585 aa, Artificial Sequence; identical to SEQ ID NO: 26979
  hemagglutinin__InfluenzaB__AGX16775

SEQ ID NO: 27082 - protein, 585 aa, Artificial Sequence
  hemagglutinin__InfluenzaB__AGX16797
MKAIIVLLMVVTSNADRICTGITSSNSPHVVKTATQGEVNVTGVIPLTTTPTKSHFANLKGTKTRGKLCPKCLNCTDLDVALGRPKCTGNMPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27083 - protein, 585 aa, Artificial Sequence; identical to SEQ ID NO: 26979
  hemagglutinin__InfluenzaB__AGX16808

SEQ ID NO: 27084 - protein, 585 aa, Artificial Sequence
  hemagglutinin__InfluenzaB__AGX16819
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFIVYMVSRDNVSCSICL

SEQ ID NO: 27085 - protein, 585 aa, Artificial Sequence; identical to SEQ ID NO: 26979
  hemagglutinin__InfluenzaB__AGX16830

SEQ ID NO: 27086 - protein, 585 aa, Artificial Sequence
  hemagglutinin__InfluenzaB__AGX16841
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGMTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNGDGLDNHTILLYYSTAASSLAVTLMIAIFVVYMVSRDNVSCSICL

SEQ ID NO: 27087 - protein, 585 aa, Artificial Sequence
  hemagglutinin__InfluenzaB__AGX16852
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRISGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27088 - protein, 585 aa, Artificial Sequence; identical to SEQ ID NO: 26979
  hemagglutinin__InfluenzaB__AGX16863

SEQ ID NO: 27089 - protein, 585 aa, Artificial Sequence; identical to SEQ ID NO: 26979
  hemagglutinin__InfluenzaB__AGX16874

SEQ ID NO: 27090 - protein, 585 aa, Artificial Sequence
  hemagglutinin__InfluenzaB__AGX16885
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAIEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27091 - protein, 585 aa, Artificial Sequence; identical to SEQ ID NO: 27090
  hemagglutinin__InfluenzaB__AGX16896

SEQ ID NO: 27092 - protein, 585 aa, Artificial Sequence; identical to SEQ ID NO: 26979
  hemagglutinin__InfluenzaB__AGX16907

SEQ ID NO: 27093 - protein, 585 aa, Artificial Sequence; identical to SEQ ID NO: 27064
  hemagglutinin__InfluenzaB__AGX16918

SEQ ID NO: 27094 - protein, 585 aa, Artificial Sequence; identical to SEQ ID NO: 26979
  hemagglutinin__InfluenzaB__AGX16940

SEQ ID NO: 27095 - protein, 585 aa, Artificial Sequence; identical to SEQ ID NO: 27090
  hemagglutinin__InfluenzaB__AGX16951

SEQ ID NO: 27096 - protein, 585 aa, Artificial Sequence
  hemagglutinin__InfluenzaB__AGX16962
MKAIIVLLMVVTSNADRICTGITSSNSPHVVKTATQGEVNVTGVIPLTTTPTESHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQKEDGGLPQSGRIVVDYMVQKSGNTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27097 - protein, 585 aa, Artificial Sequence; identical to SEQ ID NO: 26979
  hemagglutinin__InfluenzaB__AGX16973

SEQ ID NO: 27098 - protein, 585 aa, Artificial Sequence
  hemagglutinin__InfluenzaB__AGX16995
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTVEVPYICTEGEDQITVWGFHSDNEIQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27099 - protein, 585 aa, Artificial Sequence
  hemagglutinin__InfluenzaB__AGX17006
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNENQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27100 - protein, 585 aa, Artificial Sequence; identical to SEQ ID NO: 26979
  hemagglutinin__InfluenzaB__AGX17017

SEQ ID NO: 27101 - protein, 585 aa, Artificial Sequence; identical to SEQ ID NO: 26979
  hemagglutinin__InfluenzaB__AGX17028

SEQ ID NO: 27102 - protein, 585 aa, Artificial Sequence
  hemagglutinin__InfluenzaB__AGX17039
MKAIIVLLMVVTSNADRICTGITSSNSPHVVKTATQGEVNVTGVIPLTTTPTESHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGNTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTIMLYYSTAASSLAVTLMIAIFVVYMVSRDNVSCSICL

SEQ ID NO: 27103 - protein, 585 aa, Artificial Sequence; identical to SEQ ID NO: 26979
  hemagglutinin__InfluenzaB__AGX17050

SEQ ID NO: 27104 - protein, 585 aa, Artificial Sequence
  hemagglutinin__InfluenzaB__AGX17061
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYERIRLSNHNVINAEKAPGGPYKIGTSGSCPNVTNGNGFFATMAWAVPKNENNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMIAIFVVYMVSRDNVSCSICL

SEQ ID NO: 27105 - protein, 585 aa, Artificial Sequence
  hemagglutinin__InfluenzaB__AGX17072
MKAIIVLLMVVTSNADRICTGITSSNSPHVVKTATQGEVNVTGVIPLTTTPTESHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGNTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27106 - protein, 585 aa, Artificial Sequence; identical to SEQ ID NO: 27090
  hemagglutinin__InfluenzaB__AGX17083

SEQ ID NO: 27107 - protein, 585 aa, Artificial Sequence
  hemagglutinin__InfluenzaB__AGX17094
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27108 - protein, 585 aa, Artificial Sequence
  hemagglutinin__InfluenzaB__AGX17105
MKAIIVLLMVVTSNADRICTGITSSNSPHVVKTATQGEINVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPHICTEGEDQITVWGFHSDNEIQMAKLYGDSKPQKFTSSANGVTTHYISQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAIEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27109 - protein, 585 aa, Artificial Sequence; identical to SEQ ID NO: 27090
  hemagglutinin__InfluenzaB__AGX17116

SEQ ID NO: 27110 - protein, 585 aa, Artificial Sequence
  hemagglutinin__InfluenzaB__AGX17127
MKAIIVLLMVVTSNADRICTGITSSNSPHVVKTATQGEVNVTGVIPLTTTPTESHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNENQMAKLYGDSKPQKFTSSANGVTTHYVSQIGGFPNQTEDGGLPQSGRIVVDYMVQKSGNTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27111 - protein, 585 aa, Artificial Sequence; identical to SEQ ID NO: 27099
  hemagglutinin__InfluenzaB__AGX17138

SEQ ID NO: 27112 - protein, 585 aa, Artificial Sequence; identical to SEQ ID NO: 27099
  hemagglutinin__InfluenzaB__AGX17149

SEQ ID NO: 27113 - protein, 585 aa, Artificial Sequence
  hemagglutinin__InfluenzaB__AGX17160
MKAIIVLLMVVTSNADRICTGITSSNSPHVVKTATQGEVNVTGMIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27114 - protein, 585 aa, Artificial Sequence
  hemagglutinin__InfluenzaB__AGX17171
MKAIIVLLMVVTSNADRICTGITSSNSPHVVKTATQGEVNVTGVIPLTTTPTESHFANLKGTKTRGKLCPKCLNCTDLDVALGRPKCTGNIPSAKVSILHEVRPVTSGCFPIMHNRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGNTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27115 - protein, 585 aa, Artificial Sequence; identical to SEQ ID NO: 26979
  hemagglutinin__InfluenzaB__AGX17182

SEQ ID NO: 27116 - protein, 585 aa, Artificial Sequence; identical to SEQ ID NO: 26979
  hemagglutinin__InfluenzaB__AGX17193

SEQ ID NO: 27117 - protein, 585 aa, Artificial Sequence; identical to SEQ ID NO: 26979
  hemagglutinin__InfluenzaB__AGX17204

SEQ ID NO: 27118 - protein, 585 aa, Artificial Sequence
  hemagglutinin__InfluenzaB__AGX17215
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAIEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27119 - protein, 585 aa, Artificial Sequence; identical to SEQ ID NO: 26979
  hemagglutinin__InfluenzaB__AGX17226

SEQ ID NO: 27120 - protein, 585 aa, Artificial Sequence
  hemagglutinin__InfluenzaB__AGX17237
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNITNGNGFFATMAWAVPKNDNNKTATNSLTIEVPYICTEGEDQITVWGFHSDNEIQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27121 - protein, 585 aa, Artificial Sequence
  hemagglutinin__InfluenzaB__AGX17248
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCTSGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27122 - protein, 585 aa, Artificial Sequence; identical to SEQ ID NO: 27063
  hemagglutinin__InfluenzaB__AGX17270

SEQ ID NO: 27123 - protein, 585 aa, Artificial Sequence; identical to SEQ ID NO: 26979
  hemagglutinin__InfluenzaB__AGX17281

SEQ ID NO: 27124 - protein, 585 aa, Artificial Sequence; identical to SEQ ID NO: 26979
  hemagglutinin__InfluenzaB__AGX17292

SEQ ID NO: 27125 - protein, 585 aa, Artificial Sequence; identical to SEQ ID NO: 26979
  hemagglutinin__InfluenzaB__AGX17303

SEQ ID NO: 27126 - protein, 585 aa, Artificial Sequence; identical to SEQ ID NO: 27105
  hemagglutinin__InfluenzaB__AGX17314

SEQ ID NO: 27127 - protein, 585 aa, Artificial Sequence; identical to SEQ ID NO: 26979
  hemagglutinin__InfluenzaB__AGX17325

SEQ ID NO: 27128 - protein, 585 aa, Artificial Sequence; identical to SEQ ID NO: 27090
  hemagglutinin__InfluenzaB__AGX17336

SEQ ID NO: 27129 - protein, 585 aa, Artificial Sequence; identical to SEQ ID NO: 26979
  hemagglutinin__InfluenzaB__AGX17347

SEQ ID NO: 27130 - protein, 585 aa, Artificial Sequence; identical to SEQ ID NO: 26979
  hemagglutinin__InfluenzaB__AGX17358

SEQ ID NO: 27131 - protein, 585 aa, Artificial Sequence
  hemagglutinin__InfluenzaB__AGX17369
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVADYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27132 - protein, 585 aa, Artificial Sequence; identical to SEQ ID NO: 27105
  hemagglutinin__InfluenzaB__AGX17380

SEQ ID NO: 27133 - protein, 585 aa, Artificial Sequence; identical to SEQ ID NO: 26979
  hemagglutinin__InfluenzaB__AGX17391

SEQ ID NO: 27134 - protein, 585 aa, Artificial Sequence
  hemagglutinin__InfluenzaB__AGX17400
MKAIIVLLMVVTSNADRICTGITSSNSPHMVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27135 - protein, 585 aa, Artificial Sequence; identical to SEQ ID NO: 26979
  hemagglutinin__InfluenzaB__AGX17411

SEQ ID NO: 27136 - protein, 585 aa, Artificial Sequence; identical to SEQ ID NO: 26979
  hemagglutinin__InfluenzaB__AGX17422

SEQ ID NO: 27137 - protein, 585 aa, Artificial Sequence; identical to SEQ ID NO: 27062
  hemagglutinin__InfluenzaB__AGX17433

SEQ ID NO: 27138 - protein, 585 aa, Artificial Sequence; identical to SEQ ID NO: 26979
  hemagglutinin__InfluenzaB__AGX17444

SEQ ID NO: 27139 - protein, 585 aa, Artificial Sequence; identical to SEQ ID NO: 27062
  hemagglutinin__InfluenzaB__AGX17455

SEQ ID NO: 27140 - protein, 585 aa, Artificial Sequence; identical to SEQ ID NO: 27105
  hemagglutinin__InfluenzaB__AGX17466

SEQ ID NO: 27141 - protein, 585 aa, Artificial Sequence; identical to SEQ ID NO: 26979
  hemagglutinin__InfluenzaB__AGX17477

SEQ ID NO: 27142 - protein, 585 aa, Artificial Sequence; identical to SEQ ID NO: 27064
  hemagglutinin__InfluenzaB__AGX17488

SEQ ID NO: 27143 - protein, 585 aa, Artificial Sequence; identical to SEQ ID NO: 26979
  hemagglutinin__InfluenzaB__AGX17499

SEQ ID NO: 27144 - protein, 585 aa, Artificial Sequence; identical to SEQ ID NO: 27105
  hemagglutinin__InfluenzaB__AGX17510

SEQ ID NO: 27145 - protein, 585 aa, Artificial Sequence; identical to SEQ ID NO: 27105
  hemagglutinin__InfluenzaB__AGX17521

SEQ ID NO: 27146 - protein, 585 aa, Artificial Sequence; identical to SEQ ID NO: 27107
  hemagglutinin__InfluenzaB__AGX17532

SEQ ID NO: 27147 - protein, 585 aa, Artificial Sequence
  hemagglutinin__InfluenzaB__AGX17543
MKAIIVLLMVVTSNADRICTGITSSNSPHVVKTATQGEVNVTGVIPLTTTPTKSHFASLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMNELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27148 - protein, 585 aa, Artificial Sequence
  hemagglutinin__InfluenzaB__AGX17554
MKAIIVLLLVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27149 - protein, 584 aa, Artificial Sequence; identical to SEQ ID NO: 27023
  hemagglutinin__InfluenzaB__AGX17565

SEQ ID NO: 27150 - protein, 585 aa, Artificial Sequence
  hemagglutinin__InfluenzaB__AGX17576
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMMAIFVVYMVSRDNVSCSICL

SEQ ID NO: 27151 - protein, 585 aa, Artificial Sequence; identical to SEQ ID NO: 26514
  hemagglutinin__InfluenzaB__AGX17598

SEQ ID NO: 27152 - protein, 585 aa, Artificial Sequence
  hemagglutinin__InfluenzaB__AGX17609
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27153 - protein, 585 aa, Artificial Sequence; identical to SEQ ID NO: 26981
  hemagglutinin__InfluenzaB__AGX17620

SEQ ID NO: 27154 - protein, 585 aa, Artificial Sequence; identical to SEQ ID NO: 26514
  hemagglutinin__InfluenzaB__AGX17631

SEQ ID NO: 27155 - protein, 585 aa, Artificial Sequence; identical to SEQ ID NO: 26638
  hemagglutinin__InfluenzaB__AGX17642

SEQ ID NO: 27156 - protein, 585 aa, Artificial Sequence; identical to SEQ ID NO: 26981
  hemagglutinin__InfluenzaB__AGX17653

SEQ ID NO: 27157 - protein, 585 aa, Artificial Sequence; identical to SEQ ID NO: 26514
  hemagglutinin__InfluenzaB__AGX17664

SEQ ID NO: 27158 - protein, 585 aa, Artificial Sequence; identical to SEQ ID NO: 26638
  hemagglutinin__InfluenzaB__AGX17675

SEQ ID NO: 27159 - protein, 585 aa, Artificial Sequence; identical to SEQ ID NO: 26981
  hemagglutinin__InfluenzaB__AGX17686

SEQ ID NO: 27160 - protein, 585 aa, Artificial Sequence
  hemagglutinin__InfluenzaB__AGX17697
MKAIIVLLMVVTSNADRICTGITSSNSPHVVKTATQGEVNVTGVIPLTTTPTKSHFANLKGTETRGKLCPKCLNCTDLDVALGRPKCTGEIPSARVSILHEVRPVTSGCFPIMHDRTKIRQLPNLLRGYEHIRLSTHNAINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27161 - protein, 585 aa, Artificial Sequence; identical to SEQ ID NO: 26638
  hemagglutinin__InfluenzaB__AGX17708

SEQ ID NO: 27162 - protein, 585 aa, Artificial Sequence; identical to SEQ ID NO: 26981
  hemagglutinin__InfluenzaB__AGX17719

SEQ ID NO: 27163 - protein, 585 aa, Artificial Sequence; identical to SEQ ID NO: 26638
  hemagglutinin__InfluenzaB__AGX17730

SEQ ID NO: 27164 - protein, 585 aa, Artificial Sequence; identical to SEQ ID NO: 26514
  hemagglutinin__InfluenzaB__AGX17741

SEQ ID NO: 27165 - protein, 585 aa, Artificial Sequence; identical to SEQ ID NO: 26981
  hemagglutinin__InfluenzaB__AGX17752

SEQ ID NO: 27166 - protein, 585 aa, Artificial Sequence; identical to SEQ ID NO: 26981
  hemagglutinin__InfluenzaB__AGX17774

SEQ ID NO: 27167 - protein, 585 aa, Artificial Sequence
  hemagglutinin__InfluenzaB__AGX17785
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHVRLSTHNVINAEKAPGGPYKIGTSGSCPNVTNGNGFFATMAWAVPKNDNNKTATNSLTIEVPYICTEGEDQITIWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27168 - protein, 585 aa, Artificial Sequence; identical to SEQ ID NO: 26981
  hemagglutinin__InfluenzaB__AGX17796

SEQ ID NO: 27169 - protein, 585 aa, Artificial Sequence; identical to SEQ ID NO: 26565
  hemagglutinin__InfluenzaB__AGX17807

SEQ ID NO: 27170 - protein, 585 aa, Artificial Sequence; identical to SEQ ID NO: 27152
  hemagglutinin__InfluenzaB__AGX17818

SEQ ID NO: 27171 - protein, 585 aa, Artificial Sequence
  hemagglutinin__InfluenzaB__AGX17829
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAVNKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27172 - protein, 585 aa, Artificial Sequence; identical to SEQ ID NO: 26638
  hemagglutinin__InfluenzaB__AGX17840

SEQ ID NO: 27173 - protein, 585 aa, Artificial Sequence; identical to SEQ ID NO: 26981
  hemagglutinin__InfluenzaB__AGX17851

SEQ ID NO: 27174 - protein, 585 aa, Artificial Sequence
  hemagglutinin__InfluenzaB__AGX17862
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGTLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27175 - protein, 585 aa, Artificial Sequence
  hemagglutinin__InfluenzaB__AGX17873
MKAIIVLLMVVTSNADRICTGITSSNSPHVVKTATQGEVNVTGVIPLTTTPTKSHFANLKGTETRGKLCPKCLDCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27176 - protein, 585 aa, Artificial Sequence; identical to SEQ ID NO: 26638
  hemagglutinin__InfluenzaB__AGX17884

SEQ ID NO: 27177 - protein, 585 aa, Artificial Sequence
  hemagglutinin__InfluenzaB__AGX17895
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNENQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27178 - protein, 585 aa, Artificial Sequence; identical to SEQ ID NO: 26638
  hemagglutinin__InfluenzaB__AGX17906

SEQ ID NO: 27179 - protein, 585 aa, Artificial Sequence; identical to SEQ ID NO: 26638
  hemagglutinin__InfluenzaB__AGX17917

SEQ ID NO: 27180 - protein, 585 aa, Artificial Sequence
  hemagglutinin__InfluenzaB__AGX17928
MKTIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGTLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27181 - protein, 585 aa, Artificial Sequence; identical to SEQ ID NO: 26514
  hemagglutinin__InfluenzaB__AGX17939

SEQ ID NO: 27182 - protein, 585 aa, Artificial Sequence; identical to SEQ ID NO: 26514
  hemagglutinin__InfluenzaB__AGX17950

SEQ ID NO: 27183 - protein, 585 aa, Artificial Sequence; identical to SEQ ID NO: 26514
  hemagglutinin__InfluenzaB__AGX17961

SEQ ID NO: 27184 - protein, 585 aa, Artificial Sequence; identical to SEQ ID NO: 26981
  hemagglutinin__InfluenzaB__AGX17972

SEQ ID NO: 27185 - protein, 585 aa, Artificial Sequence; identical to SEQ ID NO: 26514
  hemagglutinin__InfluenzaB__AGX17983

SEQ ID NO: 27186 - protein, 585 aa, Artificial Sequence; identical to SEQ ID NO: 26638
  hemagglutinin__InfluenzaB__AGX17994

SEQ ID NO: 27187 - protein, 585 aa, Artificial Sequence
  hemagglutinin__InfluenzaB__AGX18005
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADIKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27188 - protein, 585 aa, Artificial Sequence
  hemagglutinin__InfluenzaB__AGX18016
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICIEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27189 - protein, 585 aa, Artificial Sequence; identical to SEQ ID NO: 27152
  hemagglutinin__InfluenzaB__AGX18027

SEQ ID NO: 27190 - protein, 585 aa, Artificial Sequence; identical to SEQ ID NO: 26638
  hemagglutinin__InfluenzaB__AGX18038

SEQ ID NO: 27191 - protein, 585 aa, Artificial Sequence; identical to SEQ ID NO: 26638
  hemagglutinin__InfluenzaB__AGX18049

SEQ ID NO: 27192 - protein, 585 aa, Artificial Sequence; identical to SEQ ID NO: 26638
  hemagglutinin__InfluenzaB__AGX18060

SEQ ID NO: 27193 - protein, 585 aa, Artificial Sequence; identical to SEQ ID NO: 26514
  hemagglutinin__InfluenzaB__AGX18071

SEQ ID NO: 27194 - protein, 585 aa, Artificial Sequence; identical to SEQ ID NO: 27174
  hemagglutinin__InfluenzaB__AGX18082

SEQ ID NO: 27195 - protein, 585 aa, Artificial Sequence; identical to SEQ ID NO: 27174
  hemagglutinin__InfluenzaB__AGX18093

SEQ ID NO: 27196 - protein, 585 aa, Artificial Sequence; identical to SEQ ID NO: 26981
  hemagglutinin__InfluenzaB__AGX18104

SEQ ID NO: 27197 - protein, 585 aa, Artificial Sequence; identical to SEQ ID NO: 26638
  hemagglutinin__InfluenzaB__AGX18115

SEQ ID NO: 27198 - protein, 585 aa, Artificial Sequence; identical to SEQ ID NO: 26638
  hemagglutinin__InfluenzaB__AGX18126

SEQ ID NO: 27199 - protein, 585 aa, Artificial Sequence; identical to SEQ ID NO: 26514
  hemagglutinin__InfluenzaB__AGX18137

SEQ ID NO: 27200 - protein, 585 aa, Artificial Sequence; identical to SEQ ID NO: 27174
  hemagglutinin__InfluenzaB__AGX18148

SEQ ID NO: 27201 - protein, 585 aa, Artificial Sequence; identical to SEQ ID NO: 26514
  hemagglutinin__InfluenzaB__AGX18159

SEQ ID NO: 27202 - protein, 585 aa, Artificial Sequence; identical to SEQ ID NO: 26514
  hemagglutinin__InfluenzaB__AGX18170

SEQ ID NO: 27203 - protein, 585 aa, Artificial Sequence; identical to SEQ ID NO: 27174
  hemagglutinin__InfluenzaB__AGX18181

SEQ ID NO: 27204 - protein, 585 aa, Artificial Sequence
  hemagglutinin__InfluenzaB__AGX18192
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDNETQMAKLYGDSKPQKFTSSTNGVTTHYVSQIGGFPNQTEDGGLPQSGRIVVDYMVQKPGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSSAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27205 - protein, 585 aa, Artificial Sequence; identical to SEQ ID NO: 27152
  hemagglutinin__InfluenzaB__AGX18203

SEQ ID NO: 27206 - protein, 585 aa, Artificial Sequence
  hemagglutinin__InfluenzaB__AGX18214
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKTGTSGSCPNVTNGNGFFATMAWAVPKNDNNKTATNSLTIEVPYICTEGEDQITIWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHIILLYYSTAASSLAVTLMIAIFVVYMVSRDNVSCSICL

SEQ ID NO: 27207 - protein, 585 aa, Artificial Sequence
  hemagglutinin__InfluenzaB__AGX18225
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINRITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27208 - protein, 585 aa, Artificial Sequence
  hemagglutinin__InfluenzaB__AGX18236
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDNETQMAKLYGDSKPQKFTSSANGVTTHYVSQIGGFPNQTEDGGLPQSGRIVVDYMMQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27209 - protein, 585 aa, Artificial Sequence; identical to SEQ ID NO: 26565
  hemagglutinin__InfluenzaB__AGX18247

SEQ ID NO: 27210 - protein, 585 aa, Artificial Sequence
  hemagglutinin__InfluenzaB__AGX18258
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDKNKTATNSLTIEVPYICTEGEDQITIWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGTLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27211 - protein, 585 aa, Artificial Sequence; identical to SEQ ID NO: 26514
  hemagglutinin__InfluenzaB__AGX18280

SEQ ID NO: 27212 - protein, 585 aa, Artificial Sequence
  hemagglutinin__InfluenzaB__AGX18291
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDNETQMAKLYGDSKPQKFTSSANGVTTHYVSQIGGFPNQTEDGGLPQSGRIVVDYMVQKSGKTGTITYQRGILLPQKVWCVSGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27213 - protein, 585 aa, Artificial Sequence
  hemagglutinin__InfluenzaB__AGX18302
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYKHIRLSTHNVINAEKAPGGPYKIGTSGSCPNVTNGNGFFATMAWAVPKNDNNKTATNSLTIEVPYICTEGEDQITIWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGTLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27214 - protein, 585 aa, Artificial Sequence; identical to SEQ ID NO: 26514
  hemagglutinin__InfluenzaB__AGX18313

SEQ ID NO: 27215 - protein, 585 aa, Artificial Sequence
  hemagglutinin__InfluenzaB__AGX18324
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27216 - protein, 585 aa, Artificial Sequence; identical to SEQ ID NO: 27174
  hemagglutinin__InfluenzaB__AGX18335

SEQ ID NO: 27217 - protein, 585 aa, Artificial Sequence
  hemagglutinin__InfluenzaB__AGX18346
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNEDGLDNHTILLYYSTAASSLAVTLMIAIFVVYMVSRDNVSCSICL

SEQ ID NO: 27218 - protein, 585 aa, Artificial Sequence
  hemagglutinin__InfluenzaB__AGX18357
MKAIIVLLMVVTSNADRICTGITSSNSPHVVKTATQGEVNVTGVIPLTTAPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDKETQMAKLYGDSKPQKFTSSANGVTTHYVSQIGGFPNQTEDGGLPQSGRIVVDYMVQKPGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSSAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27219 - protein, 585 aa, Artificial Sequence
  hemagglutinin__InfluenzaB__AGX18368
MKAIIVLLMVVTSNADRICTGITSSNSPHVVKTATQGEVNVTGVIPLTTAPTKSHFANLKGTKTRGKLCPKCLNCTDLDVALGRPKCTGNTPSAEVSILHEVRPVTSGCFPIMHDRTKIRQLPNLLRGYEHIRLSNHNVINAEKAPGGPYKIGTSGSCPNVTNGNGFFATMAWAVPKNDNNKTATNSLTIEVPYICTEGEDQITIWGFHSDNETQMAKLYGDSKPQKFTSSANGVTTHYVSQIGGFPNQTEDGGLPQSGRIVVDYMVQKPGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSSAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27220 - protein, 585 aa, Artificial Sequence; identical to SEQ ID NO: 26638
  hemagglutinin__InfluenzaB__AGX18379

SEQ ID NO: 27221 - protein, 585 aa, Artificial Sequence; identical to SEQ ID NO: 27174
  hemagglutinin__InfluenzaB__AGX18390

SEQ ID NO: 27222 - protein, 585 aa, Artificial Sequence
  hemagglutinin__InfluenzaB__AGX18401
MKAIIVLLMVVTSNADRICTGITSSNSPHVVKTATQGEVNVTGVIPLTTAPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDNEIQMAKLYGDSKPQKFTSSANGVTTHYVSQIGGFPNQTEDGGLPQSGRIVVDYMVQKPGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSSAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27223 - protein, 585 aa, Artificial Sequence
  hemagglutinin__InfluenzaB__AGX18412
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSNHNVINAEKAPGGPYKIGTSGSCPNVTNGNGFFATMAWAVPKNDNNKTATNSLTIEVPYICTEGEDQITIWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27224 - protein, 585 aa, Artificial Sequence; identical to SEQ ID NO: 26981
  hemagglutinin__InfluenzaB__AGX18423

SEQ ID NO: 27225 - protein, 584 aa, Artificial Sequence
  hemagglutinin__InfluenzaB__AGX18424
MKAIIVLLMVVTSNADRICTGITSSNSPHVVKTATQGEVNVTGVIPLTTTPIKSHFANLKGTRTRGKLCPDCLNCTDLDVALGRPMCVGTTPSAKASILHEVRPVTSGCFPIMHDRTKIRQLPNLLRGYENIRLSTQNVIDAEKALGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27226 - protein, 585 aa, Artificial Sequence
  hemagglutinin__InfluenzaB__AGX18435
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDNEIQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27227 - protein, 585 aa, Artificial Sequence; identical to SEQ ID NO: 26638
  hemagglutinin__InfluenzaB__AGX18446

SEQ ID NO: 27228 - protein, 585 aa, Artificial Sequence; identical to SEQ ID NO: 27174
  hemagglutinin__InfluenzaB__AGX18457

SEQ ID NO: 27229 - protein, 585 aa, Artificial Sequence; identical to SEQ ID NO: 26981
  hemagglutinin__InfluenzaB__AGX18468

SEQ ID NO: 27230 - protein, 585 aa, Artificial Sequence; identical to SEQ ID NO: 27174
  hemagglutinin__InfluenzaB__AGX18479

SEQ ID NO: 27231 - protein, 585 aa, Artificial Sequence; identical to SEQ ID NO: 26514
  hemagglutinin__InfluenzaB__AGX18490

SEQ ID NO: 27232 - protein, 585 aa, Artificial Sequence
  hemagglutinin__InfluenzaB__AGX18512
MKAIIVLLMVVTSNADRICTGITSSNSPHVVKTATQGEVNVTGVIPLTTTPTKSHFANLKGTETRGRLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27233 - protein, 585 aa, Artificial Sequence; identical to SEQ ID NO: 26514
  hemagglutinin__InfluenzaB__AGX18523

SEQ ID NO: 27234 - protein, 585 aa, Artificial Sequence; identical to SEQ ID NO: 26514
  hemagglutinin__InfluenzaB__AGX18534

SEQ ID NO: 27235 - protein, 585 aa, Artificial Sequence; identical to SEQ ID NO: 26575
  hemagglutinin__InfluenzaB__AGX18545

SEQ ID NO: 27236 - protein, 585 aa, Artificial Sequence; identical to SEQ ID NO: 26514
  hemagglutinin__InfluenzaB__AGX18556

SEQ ID NO: 27237 - protein, 585 aa, Artificial Sequence; identical to SEQ ID NO: 26514
  hemagglutinin__InfluenzaB__AGX18567

SEQ ID NO: 27238 - protein, 585 aa, Artificial Sequence
  hemagglutinin__InfluenzaB__AGX18578
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHKEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27239 - protein, 585 aa, Artificial Sequence
  hemagglutinin__InfluenzaB__AGX18589
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDTETQMAKLYGDSKPQKFTSSANGVTTHYVSQIGDFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27240 - protein, 585 aa, Artificial Sequence; identical to SEQ ID NO: 26514
  hemagglutinin__InfluenzaB__AGX18600

SEQ ID NO: 27241 - protein, 585 aa, Artificial Sequence; identical to SEQ ID NO: 26514
  hemagglutinin__InfluenzaB__AGX18611

SEQ ID NO: 27242 - protein, 585 aa, Artificial Sequence; identical to SEQ ID NO: 26514
  hemagglutinin__InfluenzaB__AGX18622

SEQ ID NO: 27243 - protein, 585 aa, Artificial Sequence; identical to SEQ ID NO: 26514
  hemagglutinin__InfluenzaB__AGX18633

SEQ ID NO: 27244 - protein, 585 aa, Artificial Sequence; identical to SEQ ID NO: 26514
  hemagglutinin__InfluenzaB__AGX18644

SEQ ID NO: 27245 - protein, 585 aa, Artificial Sequence; identical to SEQ ID NO: 26514
  hemagglutinin__InfluenzaB__AGX18655

SEQ ID NO: 27246 - protein, 585 aa, Artificial Sequence; identical to SEQ ID NO: 26514
  hemagglutinin__InfluenzaB__AGX18666

SEQ ID NO: 27247 - protein, 585 aa, Artificial Sequence; identical to SEQ ID NO: 26514
  hemagglutinin__InfluenzaB__AGX18677

SEQ ID NO: 27248 - protein, 585 aa, Artificial Sequence; identical to SEQ ID NO: 26514
  hemagglutinin__InfluenzaB__AGX18688

SEQ ID NO: 27249 - protein, 585 aa, Artificial Sequence; identical to SEQ ID NO: 26514
  hemagglutinin__InfluenzaB__AGX18699

SEQ ID NO: 27250 - protein, 585 aa, Artificial Sequence; identical to SEQ ID NO: 26514
  hemagglutinin__InfluenzaB__AGX18710

SEQ ID NO: 27251 - protein, 585 aa, Artificial Sequence; identical to SEQ ID NO: 26514
  hemagglutinin__InfluenzaB__AGX18721

SEQ ID NO: 27252 - protein, 585 aa, Artificial Sequence; identical to SEQ ID NO: 26514
  hemagglutinin__InfluenzaB__AGX18732

SEQ ID NO: 27253 - protein, 585 aa, Artificial Sequence
  hemagglutinin__InfluenzaB__AGX18743
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSNHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27254 - protein, 585 aa, Artificial Sequence; identical to SEQ ID NO: 26514
  hemagglutinin__InfluenzaB__AGX18754

SEQ ID NO: 27255 - protein, 585 aa, Artificial Sequence; identical to SEQ ID NO: 26514
  hemagglutinin__InfluenzaB__AGX18765

SEQ ID NO: 27256 - protein, 585 aa, Artificial Sequence; identical to SEQ ID NO: 26565
  hemagglutinin__InfluenzaB__AGX18776

SEQ ID NO: 27257 - protein, 585 aa, Artificial Sequence; identical to SEQ ID NO: 26514
  hemagglutinin__InfluenzaB__AGX18787

SEQ ID NO: 27258 - protein, 585 aa, Artificial Sequence; identical to SEQ ID NO: 26514
  hemagglutinin__InfluenzaB__AGX18798

SEQ ID NO: 27259 - protein, 585 aa, Artificial Sequence
  hemagglutinin__InfluenzaB__AGX18809
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDSETQMAKLYGDSKPQKFTSSANGVTTHYVSQIGGFPNQTEDGGLPQSGRIVVDYMMQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27260 - protein, 585 aa, Artificial Sequence; identical to SEQ ID NO: 27177
  hemagglutinin__InfluenzaB__AGX18820

SEQ ID NO: 27261 - protein, 585 aa, Artificial Sequence; identical to SEQ ID NO: 26514
  hemagglutinin__InfluenzaB__AGX18831

SEQ ID NO: 27262 - protein, 585 aa, Artificial Sequence; identical to SEQ ID NO: 26514
  hemagglutinin__InfluenzaB__AGX18842

SEQ ID NO: 27263 - protein, 585 aa, Artificial Sequence; identical to SEQ ID NO: 26582
  hemagglutinin__InfluenzaB__AGX18853

SEQ ID NO: 27264 - protein, 585 aa, Artificial Sequence
  hemagglutinin__InfluenzaB__AGX18864
MKAIIVLLMVVTSNADRICTGITSSNSPHVVKTATQGEVNVTGVIPLTTTPTKSYFANLKGTETRGKLCPKCLNCTDLDVALGRPKCTGNIPSARVSILHEVRPVTSGCFPIMHDRTKIRQLPNLLRGYEHIRLSNHNVINAENAPGGPYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27265 - protein, 585 aa, Artificial Sequence
  hemagglutinin__InfluenzaB__AGX18875
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNRNGFFATMAWAVPKNDNNKTATNSLTIEVPYICTEGEDQITVWGFHSDNEIQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAIDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27266 - protein, 585 aa, Artificial Sequence
  hemagglutinin__InfluenzaB__AGX18886
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNEIQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDNGLDNHTILLYYSTAASSLAVTLIIAIFVVYMVSRDNVSCSICL

SEQ ID NO: 27267 - protein, 585 aa, Artificial Sequence; identical to SEQ ID NO: 26987
  hemagglutinin__InfluenzaB__AGX18897

SEQ ID NO: 27268 - protein, 585 aa, Artificial Sequence; identical to SEQ ID NO: 26514
  hemagglutinin__InfluenzaB__AGX18908

SEQ ID NO: 27269 - protein, 585 aa, Artificial Sequence; identical to SEQ ID NO: 26514
  hemagglutinin__InfluenzaB__AGX18919

SEQ ID NO: 27270 - protein, 585 aa, Artificial Sequence
  hemagglutinin__InfluenzaB__AGX18930
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCIDRIAAGTFDAGEFSLPTFDSLNITAASLNDDGLDNHTILLYYSTAASSLAVTLMIAIFVVYMVSRDNVSCSICL

SEQ ID NO: 27271 - protein, 585 aa, Artificial Sequence; identical to SEQ ID NO: 26514
  hemagglutinin__InfluenzaB__AGX18941

SEQ ID NO: 27272 - protein, 585 aa, Artificial Sequence; identical to SEQ ID NO: 26514
  hemagglutinin__InfluenzaB__AGX18952

SEQ ID NO: 27273 - protein, 585 aa, Artificial Sequence; identical to SEQ ID NO: 26514
  hemagglutinin__InfluenzaB__AGX18963

SEQ ID NO: 27274 - protein, 585 aa, Artificial Sequence
  hemagglutinin__InfluenzaB__AGX18974
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALEKKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27275 - protein, 585 aa, Artificial Sequence; identical to SEQ ID NO: 26514
  hemagglutinin__InfluenzaB__AGX18985

SEQ ID NO: 27276 - protein, 585 aa, Artificial Sequence
  hemagglutinin__InfluenzaB__AGX18996
MKAIIVLLMVVTSNADRICTGITSSNSPHVVKTATQGEVNVTGVIPLTTTPTKSHFANLKGTETRGKLCPKCLNCTDLDVALGRPKCTGNTPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNGTQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27277 - protein, 585 aa, Artificial Sequence; identical to SEQ ID NO: 26514
  hemagglutinin__InfluenzaB__AGX19007

SEQ ID NO: 27278 - protein, 585 aa, Artificial Sequence
  hemagglutinin__InfluenzaB__AGX19018
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNFLRGYEHIRLSTHNVINAENAPGGPYKIGTSGSCPNVTNGNGFFATMAWAVPKNDNNKTATNSLTIEVPYICTEGEDQITVWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27279 - protein, 585 aa, Artificial Sequence; identical to SEQ ID NO: 27177
  hemagglutinin__InfluenzaB__AGX19029

SEQ ID NO: 27280 - protein, 585 aa, Artificial Sequence; identical to SEQ ID NO: 26514
  hemagglutinin__InfluenzaB__AGX19040

SEQ ID NO: 27281 - protein, 585 aa, Artificial Sequence
  hemagglutinin__InfluenzaB__AGX19051
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINTENAPGGPYKIGTSGSCPNVTNGNGFFATMAWAVPKNDNNKTATNSLTIEVPYICTEGEDQITVWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27282 - protein, 585 aa, Artificial Sequence
  hemagglutinin__InfluenzaB__AGX19062
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNFNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27283 - protein, 585 aa, Artificial Sequence; identical to SEQ ID NO: 26514
  hemagglutinin__InfluenzaB__AGX19073

SEQ ID NO: 27284 - protein, 585 aa, Artificial Sequence
  hemagglutinin__InfluenzaB__AGX19084
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIKLSTHNVINAENAPGGPYKIGTSGSCPNVTNGNGFFATMAWAVPKNDNNKTATNSLTIEVPYICTEGEDQITVWGFHSDNENQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27285 - protein, 585 aa, Artificial Sequence; identical to SEQ ID NO: 26514
  hemagglutinin__InfluenzaB__AGX19095

SEQ ID NO: 27286 - protein, 585 aa, Artificial Sequence; identical to SEQ ID NO: 27177
  hemagglutinin__InfluenzaB__AGX19106

SEQ ID NO: 27287 - protein, 585 aa, Artificial Sequence; identical to SEQ ID NO: 26514
  hemagglutinin__InfluenzaB__AGX19117

SEQ ID NO: 27288 - protein, 585 aa, Artificial Sequence
  hemagglutinin__InfluenzaB__AGX19128
MKAIIVLLMVVTSNADRICTGITSSNSPHVVKTATQGEVNVTGVIPLTTTPTKSHFANLKGTETRGKLCPKCLNCTDLDVALGRPKCTGNTPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27289 - protein, 585 aa, Artificial Sequence; identical to SEQ ID NO: 26514
  hemagglutinin__InfluenzaB__AGX19139

SEQ ID NO: 27290 - protein, 585 aa, Artificial Sequence; identical to SEQ ID NO: 26987
  hemagglutinin__InfluenzaB__AGX19150

SEQ ID NO: 27291 - protein, 585 aa, Artificial Sequence; identical to SEQ ID NO: 26514
  hemagglutinin__InfluenzaB__AGX19161

SEQ ID NO: 27292 - protein, 585 aa, Artificial Sequence; identical to SEQ ID NO: 26987
  hemagglutinin__InfluenzaB__AGX19172

SEQ ID NO: 27293 - protein, 585 aa, Artificial Sequence
  hemagglutinin__InfluenzaB__AGX19183
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDTETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27294 - protein, 585 aa, Artificial Sequence; identical to SEQ ID NO: 26514
  hemagglutinin__InfluenzaB__AGX19194

SEQ ID NO: 27295 - protein, 585 aa, Artificial Sequence
  hemagglutinin__InfluenzaB__AGX19205
MKAIIVLLMVVTSNADRVCTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27296 - protein, 585 aa, Artificial Sequence
  hemagglutinin__InfluenzaB__AGX19216
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKPGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27297 - protein, 585 aa, Artificial Sequence
  hemagglutinin__InfluenzaB__AGX19227
MKAIIVLLMVVTSNADRICTGITSSNSPHVVKTATQGEVNVTGVIPLTTTPTKSHFANLKGTETRGKLCPQCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKSDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27298 - protein, 585 aa, Artificial Sequence
  hemagglutinin__InfluenzaB__AGX19238
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27299 - protein, 585 aa, Artificial Sequence; identical to SEQ ID NO: 27298
  hemagglutinin__InfluenzaB__AGX19249

SEQ ID NO: 27300 - protein, 585 aa, Artificial Sequence; identical to SEQ ID NO: 26514
  hemagglutinin__InfluenzaB__AGX19260

SEQ ID NO: 27301 - protein, 585 aa, Artificial Sequence; identical to SEQ ID NO: 26514
  hemagglutinin__InfluenzaB__AGX19271

SEQ ID NO: 27302 - protein, 585 aa, Artificial Sequence
  hemagglutinin__InfluenzaB__AGX19282
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCTSGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27303 - protein, 585 aa, Artificial Sequence
  hemagglutinin__InfluenzaB__AGX19304
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTAINSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27304 - protein, 585 aa, Artificial Sequence; identical to SEQ ID NO: 27303
  hemagglutinin__InfluenzaB__AGX19315

SEQ ID NO: 27305 - protein, 585 aa, Artificial Sequence; identical to SEQ ID NO: 27302
  hemagglutinin__InfluenzaB__AGX19326

SEQ ID NO: 27306 - protein, 585 aa, Artificial Sequence; identical to SEQ ID NO: 27302
  hemagglutinin__InfluenzaB__AGX19337

SEQ ID NO: 27307 - protein, 585 aa, Artificial Sequence
  hemagglutinin__InfluenzaB__AGX19348
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCTSGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27308 - protein, 585 aa, Artificial Sequence; identical to SEQ ID NO: 27302
  hemagglutinin__InfluenzaB__AGX19359

SEQ ID NO: 27309 - protein, 584 aa, Artificial Sequence; identical to SEQ ID NO: 26731
  hemagglutinin__InfluenzaB__AGX19370

SEQ ID NO: 27310 - protein, 585 aa, Artificial Sequence; identical to SEQ ID NO: 26565
  hemagglutinin__InfluenzaB__AGX19381

SEQ ID NO: 27311 - protein, 585 aa, Artificial Sequence; identical to SEQ ID NO: 27302
  hemagglutinin__InfluenzaB__AGX19392

SEQ ID NO: 27312 - protein, 585 aa, Artificial Sequence; identical to SEQ ID NO: 27302
  hemagglutinin__InfluenzaB__AGX19403

SEQ ID NO: 27313 - protein, 585 aa, Artificial Sequence; identical to SEQ ID NO: 26989
  hemagglutinin__InfluenzaB__AGX19414

SEQ ID NO: 27314 - protein, 584 aa, Artificial Sequence
  hemagglutinin__InfluenzaB__AGX19425
MKTIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMRNLYGDSNPQKFTSSANGVTTHYVSQIGSFPDQTEDGGLPQSGRIVVDYMMQKPGKTGTIVYQRGVLLPQRVWCASGRSKVIKGALPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27315 - protein, 585 aa, Artificial Sequence; identical to SEQ ID NO: 26514
  hemagglutinin__InfluenzaB__AGX19436

SEQ ID NO: 27316 - protein, 585 aa, Artificial Sequence; identical to SEQ ID NO: 27177
  hemagglutinin__InfluenzaB__AGX19447

SEQ ID NO: 27317 - protein, 584 aa, Artificial Sequence; identical to SEQ ID NO: 27056
  hemagglutinin__InfluenzaB__AGX19458

SEQ ID NO: 27318 - protein, 584 aa, Artificial Sequence; identical to SEQ ID NO: 27056
  hemagglutinin__InfluenzaB__AGX19469

SEQ ID NO: 27319 - protein, 585 aa, Artificial Sequence; identical to SEQ ID NO: 26989
  hemagglutinin__InfluenzaB__AGX19480

SEQ ID NO: 27320 - protein, 585 aa, Artificial Sequence; identical to SEQ ID NO: 26582
  hemagglutinin__InfluenzaB__AGX19491

SEQ ID NO: 27321 - protein, 585 aa, Artificial Sequence
  hemagglutinin__InfluenzaB__AGX19502
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27322 - protein, 585 aa, Artificial Sequence
  hemagglutinin__InfluenzaB__AGX19513
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYISQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27323 - protein, 585 aa, Artificial Sequence; identical to SEQ ID NO: 27322
  hemagglutinin__InfluenzaB__AGX19524

SEQ ID NO: 27324 - protein, 585 aa, Artificial Sequence
  hemagglutinin__InfluenzaB__AGX19535
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDDETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27325 - protein, 585 aa, Artificial Sequence
  hemagglutinin__InfluenzaB__AGX19546
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDKETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27326 - protein, 585 aa, Artificial Sequence
  hemagglutinin__InfluenzaB__AGX19557
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTGGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27327 - protein, 585 aa, Artificial Sequence; identical to SEQ ID NO: 26989
  hemagglutinin__InfluenzaB__AGX19568

SEQ ID NO: 27328 - protein, 585 aa, Artificial Sequence; identical to SEQ ID NO: 27322
  hemagglutinin__InfluenzaB__AGX19579

SEQ ID NO: 27329 - protein, 585 aa, Artificial Sequence; identical to SEQ ID NO: 26989
  hemagglutinin__InfluenzaB__AGX19590

SEQ ID NO: 27330 - protein, 585 aa, Artificial Sequence; identical to SEQ ID NO: 26989
  hemagglutinin__InfluenzaB__AGX19601

SEQ ID NO: 27331 - protein, 585 aa, Artificial Sequence; identical to SEQ ID NO: 26989
  hemagglutinin__InfluenzaB__AGX19612

SEQ ID NO: 27332 - protein, 585 aa, Artificial Sequence
  hemagglutinin__InfluenzaB__AGX19623
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVALMIAIFVVYMVSRDNVSCSICL

SEQ ID NO: 27333 - protein, 585 aa, Artificial Sequence; identical to SEQ ID NO: 26989
  hemagglutinin__InfluenzaB__AGX19634

SEQ ID NO: 27334 - protein, 585 aa, Artificial Sequence; identical to SEQ ID NO: 26514
  hemagglutinin__InfluenzaB__AGX19645

SEQ ID NO: 27335 - protein, 585 aa, Artificial Sequence; identical to SEQ ID NO: 26565
  hemagglutinin__InfluenzaB__AGX19656

SEQ ID NO: 27336 - protein, 585 aa, Artificial Sequence
  hemagglutinin__InfluenzaB__AGX19667
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKDLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27337 - protein, 585 aa, Artificial Sequence; identical to SEQ ID NO: 26989
  hemagglutinin__InfluenzaB__AGX19678

SEQ ID NO: 27338 - protein, 585 aa, Artificial Sequence; identical to SEQ ID NO: 26514
  hemagglutinin__InfluenzaB__AGX19700

SEQ ID NO: 27339 - protein, 585 aa, Artificial Sequence
  hemagglutinin__InfluenzaB__AGX19711
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNSLTIEVPYICKEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27340 - protein, 585 aa, Artificial Sequence; identical to SEQ ID NO: 26989
  hemagglutinin__InfluenzaB__AGX19722

SEQ ID NO: 27341 - protein, 585 aa, Artificial Sequence; identical to SEQ ID NO: 26989
  hemagglutinin__InfluenzaB__AGX19733

SEQ ID NO: 27342 - protein, 585 aa, Artificial Sequence; identical to SEQ ID NO: 26989
  hemagglutinin__InfluenzaB__AGX19744

SEQ ID NO: 27343 - protein, 585 aa, Artificial Sequence; identical to SEQ ID NO: 26514
  hemagglutinin__InfluenzaB__AGX19755

SEQ ID NO: 27344 - protein, 585 aa, Artificial Sequence; identical to SEQ ID NO: 26989
  hemagglutinin__InfluenzaB__AGX19766

SEQ ID NO: 27345 - protein, 585 aa, Artificial Sequence; identical to SEQ ID NO: 27322
  hemagglutinin__InfluenzaB__AGX19788

SEQ ID NO: 27346 - protein, 585 aa, Artificial Sequence; identical to SEQ ID NO: 26989
  hemagglutinin__InfluenzaB__AGX19799

SEQ ID NO: 27347 - protein, 585 aa, Artificial Sequence; identical to SEQ ID NO: 26989
  hemagglutinin__InfluenzaB__AGX19810

SEQ ID NO: 27348 - protein, 585 aa, Artificial Sequence
  hemagglutinin__InfluenzaB__AGX19821
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGSMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27349 - protein, 585 aa, Artificial Sequence; identical to SEQ ID NO: 27322
  hemagglutinin__InfluenzaB__AGX19832

SEQ ID NO: 27350 - protein, 585 aa, Artificial Sequence; identical to SEQ ID NO: 26989
  hemagglutinin__InfluenzaB__AGX19843

SEQ ID NO: 27351 - protein, 585 aa, Artificial Sequence; identical to SEQ ID NO: 26989
  hemagglutinin__InfluenzaB__AGX19854

SEQ ID NO: 27352 - protein, 585 aa, Artificial Sequence; identical to SEQ ID NO: 26989
  hemagglutinin__InfluenzaB__AGX19865

SEQ ID NO: 27353 - protein, 585 aa, Artificial Sequence; identical to SEQ ID NO: 27322
  hemagglutinin__InfluenzaB__AGX19876

SEQ ID NO: 27354 - protein, 585 aa, Artificial Sequence; identical to SEQ ID NO: 26989
  hemagglutinin__InfluenzaB__AGX19887

SEQ ID NO: 27355 - protein, 585 aa, Artificial Sequence
  hemagglutinin__InfluenzaB__AGX19898
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNENGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27356 - protein, 585 aa, Artificial Sequence; identical to SEQ ID NO: 26514
  hemagglutinin__InfluenzaB__AGX19909

SEQ ID NO: 27357 - protein, 585 aa, Artificial Sequence; identical to SEQ ID NO: 26989
  hemagglutinin__InfluenzaB__AGX19920

SEQ ID NO: 27358 - protein, 585 aa, Artificial Sequence; identical to SEQ ID NO: 27355
  hemagglutinin__InfluenzaB__AGX19931

SEQ ID NO: 27359 - protein, 585 aa, Artificial Sequence; identical to SEQ ID NO: 27322
  hemagglutinin__InfluenzaB__AGX19942

SEQ ID NO: 27360 - protein, 585 aa, Artificial Sequence; identical to SEQ ID NO: 26989
  hemagglutinin__InfluenzaB__AGX19953

SEQ ID NO: 27361 - protein, 585 aa, Artificial Sequence; identical to SEQ ID NO: 26747
  hemagglutinin__InfluenzaB__AGX19964

SEQ ID NO: 27362 - protein, 585 aa, Artificial Sequence; identical to SEQ ID NO: 26514
  hemagglutinin__InfluenzaB__AGX19975

SEQ ID NO: 27363 - protein, 585 aa, Artificial Sequence
  hemagglutinin__InfluenzaB__AGX19986
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCVSGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27364 - protein, 585 aa, Artificial Sequence
  hemagglutinin__InfluenzaB__AGX19997
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQIEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27365 - protein, 585 aa, Artificial Sequence; identical to SEQ ID NO: 26989
  hemagglutinin__InfluenzaB__AGX20008

SEQ ID NO: 27366 - protein, 585 aa, Artificial Sequence; identical to SEQ ID NO: 26989
  hemagglutinin__InfluenzaB__AGX20019

SEQ ID NO: 27367 - protein, 585 aa, Artificial Sequence; identical to SEQ ID NO: 26989
  hemagglutinin__InfluenzaB__AGX20030

SEQ ID NO: 27368 - protein, 585 aa, Artificial Sequence
  hemagglutinin__InfluenzaB__AGX20041
MKAIIVLLMVVTSDADRICTGITSSNSPHVVKTATQGEVNVTGVIPLTTTPTKSHFANLKGKETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27369 - protein, 585 aa, Artificial Sequence; identical to SEQ ID NO: 26989
  hemagglutinin__InfluenzaB__AGX20052

SEQ ID NO: 27370 - protein, 585 aa, Artificial Sequence; identical to SEQ ID NO: 26989
  hemagglutinin__InfluenzaB__AGX20063

SEQ ID NO: 27371 - protein, 585 aa, Artificial Sequence
  hemagglutinin__InfluenzaB__AGX20074
MKAIIALLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27372 - protein, 585 aa, Artificial Sequence
  hemagglutinin__InfluenzaB__AGX20085
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITIWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27373 - protein, 585 aa, Artificial Sequence
  hemagglutinin__InfluenzaB__AGX20096
MKAIIVLLMVVTSNADRICTGVTSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27374 - protein, 585 aa, Artificial Sequence; identical to SEQ ID NO: 26608
  hemagglutinin__InfluenzaB__AGX20107

SEQ ID NO: 27375 - protein, 585 aa, Artificial Sequence; identical to SEQ ID NO: 26608
  hemagglutinin__InfluenzaB__AGX20118

SEQ ID NO: 27376 - protein, 585 aa, Artificial Sequence; identical to SEQ ID NO: 26608
  hemagglutinin__InfluenzaB__AGX20129

SEQ ID NO: 27377 - protein, 585 aa, Artificial Sequence; identical to SEQ ID NO: 26608
  hemagglutinin__InfluenzaB__AGX20140

SEQ ID NO: 27378 - protein, 585 aa, Artificial Sequence; identical to SEQ ID NO: 26608
  hemagglutinin__InfluenzaB__AGX20151

SEQ ID NO: 27379 - protein, 585 aa, Artificial Sequence; identical to SEQ ID NO: 26608
  hemagglutinin__InfluenzaB__AGX20162

SEQ ID NO: 27380 - protein, 585 aa, Artificial Sequence; identical to SEQ ID NO: 26608
  hemagglutinin__InfluenzaB__AGX20173

SEQ ID NO: 27381 - protein, 585 aa, Artificial Sequence; identical to SEQ ID NO: 26608
  hemagglutinin__InfluenzaB__AGX20184

SEQ ID NO: 27382 - protein, 585 aa, Artificial Sequence; identical to SEQ ID NO: 26608
  hemagglutinin__InfluenzaB__AGX20195

SEQ ID NO: 27383 - protein, 585 aa, Artificial Sequence; identical to SEQ ID NO: 26608
  hemagglutinin__InfluenzaB__AGX20206

SEQ ID NO: 27384 - protein, 585 aa, Artificial Sequence; identical to SEQ ID NO: 26608
  hemagglutinin__InfluenzaB__AGX20217

SEQ ID NO: 27385 - protein, 585 aa, Artificial Sequence; identical to SEQ ID NO: 26645
  hemagglutinin__InfluenzaB__AGX20228

SEQ ID NO: 27386 - protein, 585 aa, Artificial Sequence
  hemagglutinin__InfluenzaB__AGX20239
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQIIVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27387 - protein, 585 aa, Artificial Sequence; identical to SEQ ID NO: 26608
  hemagglutinin__InfluenzaB__AGX20250

SEQ ID NO: 27388 - protein, 585 aa, Artificial Sequence; identical to SEQ ID NO: 26608
  hemagglutinin__InfluenzaB__AGX20261

SEQ ID NO: 27389 - protein, 585 aa, Artificial Sequence; identical to SEQ ID NO: 26608
  hemagglutinin__InfluenzaB__AGX20272

SEQ ID NO: 27390 - protein, 585 aa, Artificial Sequence; identical to SEQ ID NO: 26608
  hemagglutinin__InfluenzaB__AGX20283

SEQ ID NO: 27391 - protein, 585 aa, Artificial Sequence; identical to SEQ ID NO: 26608
  hemagglutinin__InfluenzaB__AGX20294

SEQ ID NO: 27392 - protein, 585 aa, Artificial Sequence
  hemagglutinin__InfluenzaB__AGX20305
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNQLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27393 - protein, 585 aa, Artificial Sequence; identical to SEQ ID NO: 26608
  hemagglutinin__InfluenzaB__AGX20316

SEQ ID NO: 27394 - protein, 585 aa, Artificial Sequence; identical to SEQ ID NO: 26608
  hemagglutinin__InfluenzaB__AGX20327

SEQ ID NO: 27395 - protein, 585 aa, Artificial Sequence
  hemagglutinin__InfluenzaB__AGX20338
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMANLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27396 - protein, 585 aa, Artificial Sequence; identical to SEQ ID NO: 26608
  hemagglutinin__InfluenzaB__AGX20349

SEQ ID NO: 27397 - protein, 585 aa, Artificial Sequence; identical to SEQ ID NO: 26608
  hemagglutinin__InfluenzaB__AGX20360

SEQ ID NO: 27398 - protein, 585 aa, Artificial Sequence; identical to SEQ ID NO: 26645
  hemagglutinin__InfluenzaB__AGX20371

SEQ ID NO: 27399 - protein, 585 aa, Artificial Sequence
  hemagglutinin__InfluenzaB__AGX20382
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMNELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27400 - protein, 585 aa, Artificial Sequence; identical to SEQ ID NO: 26608
  hemagglutinin__InfluenzaB__AGX20393

SEQ ID NO: 27401 - protein, 585 aa, Artificial Sequence; identical to SEQ ID NO: 26645
  hemagglutinin__InfluenzaB__AGX20404

SEQ ID NO: 27402 - protein, 585 aa, Artificial Sequence; identical to SEQ ID NO: 26608
  hemagglutinin__InfluenzaB__AGX20415

SEQ ID NO: 27403 - protein, 585 aa, Artificial Sequence; identical to SEQ ID NO: 26608
  hemagglutinin__InfluenzaB__AGX20426

SEQ ID NO: 27404 - protein, 585 aa, Artificial Sequence; identical to SEQ ID NO: 26608
  hemagglutinin__InfluenzaB__AGX20437

SEQ ID NO: 27405 - protein, 585 aa, Artificial Sequence; identical to SEQ ID NO: 26608
  hemagglutinin__InfluenzaB__AGX20448

SEQ ID NO: 27406 - protein, 585 aa, Artificial Sequence; identical to SEQ ID NO: 26608
  hemagglutinin__InfluenzaB__AGX20459

SEQ ID NO: 27407 - protein, 585 aa, Artificial Sequence; identical to SEQ ID NO: 26608
  hemagglutinin__InfluenzaB__AGX20470

SEQ ID NO: 27408 - protein, 585 aa, Artificial Sequence; identical to SEQ ID NO: 26608
  hemagglutinin__InfluenzaB__AGX20481

SEQ ID NO: 27409 - protein, 585 aa, Artificial Sequence; identical to SEQ ID NO: 26608
  hemagglutinin__InfluenzaB__AGX20492

SEQ ID NO: 27410 - protein, 585 aa, Artificial Sequence; identical to SEQ ID NO: 26608
  hemagglutinin__InfluenzaB__AGX20503

SEQ ID NO: 27411 - protein, 585 aa, Artificial Sequence; identical to SEQ ID NO: 26608
  hemagglutinin__InfluenzaB__AGX20514

SEQ ID NO: 27412 - protein, 585 aa, Artificial Sequence
  hemagglutinin__InfluenzaB__AGX20525
MKAIIVLLMVVTSNADRICTGITSSNSPHVVKTATQGEVNVTGVIPLTTTPTKSHFSNLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27413 - protein, 585 aa, Artificial Sequence; identical to SEQ ID NO: 26608
  hemagglutinin__InfluenzaB__AGX20536

SEQ ID NO: 27414 - protein, 585 aa, Artificial Sequence
  hemagglutinin__InfluenzaB__AGX20547
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHHVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEIKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27415 - protein, 585 aa, Artificial Sequence; identical to SEQ ID NO: 26662
  hemagglutinin__InfluenzaB__AGX20558

SEQ ID NO: 27416 - protein, 585 aa, Artificial Sequence; identical to SEQ ID NO: 26608
  hemagglutinin__InfluenzaB__AGX20569

SEQ ID NO: 27417 - protein, 585 aa, Artificial Sequence; identical to SEQ ID NO: 26645
  hemagglutinin__InfluenzaB__AGX20580

SEQ ID NO: 27418 - protein, 585 aa, Artificial Sequence; identical to SEQ ID NO: 26608
  hemagglutinin__InfluenzaB__AGX20591

SEQ ID NO: 27419 - protein, 585 aa, Artificial Sequence; identical to SEQ ID NO: 26608
  hemagglutinin__InfluenzaB__AGX20602

SEQ ID NO: 27420 - protein, 585 aa, Artificial Sequence; identical to SEQ ID NO: 26608
  hemagglutinin__InfluenzaB__AGX20613

SEQ ID NO: 27421 - protein, 585 aa, Artificial Sequence; identical to SEQ ID NO: 26608
  hemagglutinin__InfluenzaB__AGX20624

SEQ ID NO: 27422 - protein, 585 aa, Artificial Sequence
  hemagglutinin__InfluenzaB__AGX20635
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETLMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27423 - protein, 585 aa, Artificial Sequence; identical to SEQ ID NO: 26608
  hemagglutinin__InfluenzaB__AGX20646

SEQ ID NO: 27424 - protein, 585 aa, Artificial Sequence
  hemagglutinin__InfluenzaB__AGX20668
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKTKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27425 - protein, 585 aa, Artificial Sequence; identical to SEQ ID NO: 26683
  hemagglutinin__InfluenzaB__AGX20679

SEQ ID NO: 27426 - protein, 585 aa, Artificial Sequence; identical to SEQ ID NO: 26645
  hemagglutinin__InfluenzaB__AGX20690

SEQ ID NO: 27427 - protein, 585 aa, Artificial Sequence; identical to SEQ ID NO: 26645
  hemagglutinin__InfluenzaB__AGX20701

SEQ ID NO: 27428 - protein, 585 aa, Artificial Sequence; identical to SEQ ID NO: 26989
  hemagglutinin__InfluenzaB__AGX20712

SEQ ID NO: 27429 - protein, 585 aa, Artificial Sequence; identical to SEQ ID NO: 26608
  hemagglutinin__InfluenzaB__AGX20723

SEQ ID NO: 27430 - protein, 585 aa, Artificial Sequence
  hemagglutinin__InfluenzaB__AGX20734
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTNNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27431 - protein, 585 aa, Artificial Sequence
  hemagglutinin__InfluenzaB__AGX20745
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITIWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27432 - protein, 585 aa, Artificial Sequence; identical to SEQ ID NO: 26989
  hemagglutinin__InfluenzaB__AGX20756

SEQ ID NO: 27433 - protein, 585 aa, Artificial Sequence; identical to SEQ ID NO: 26608
  hemagglutinin__InfluenzaB__AGX20767

SEQ ID NO: 27434 - protein, 585 aa, Artificial Sequence; identical to SEQ ID NO: 26645
  hemagglutinin__InfluenzaB__AGX20778

SEQ ID NO: 27435 - protein, 585 aa, Artificial Sequence
  hemagglutinin__InfluenzaB__AGX20789
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHGEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27436 - protein, 585 aa, Artificial Sequence
  hemagglutinin__InfluenzaB__AGX20800
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDELDNHTILLYYSTAASSLAVTLMIAIFVVYMVSRDNVSCSICL

SEQ ID NO: 27437 - protein, 585 aa, Artificial Sequence; identical to SEQ ID NO: 26683
  hemagglutinin__InfluenzaB__AGX20811

SEQ ID NO: 27438 - protein, 585 aa, Artificial Sequence; identical to SEQ ID NO: 26683
  hemagglutinin__InfluenzaB__AGX20822

SEQ ID NO: 27439 - protein, 585 aa, Artificial Sequence; identical to SEQ ID NO: 26683
  hemagglutinin__InfluenzaB__AGX20833

SEQ ID NO: 27440 - protein, 585 aa, Artificial Sequence
  hemagglutinin__InfluenzaB__AGX20844
MKAIIVLLMVVTSNADRICTGITSSNSPHIVKTATQGEVNVTGVIPLTTTPTKSHFANLKGTETRGKLCPKCLNCTDLDVALGRPKCMGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27441 - protein, 585 aa, Artificial Sequence; identical to SEQ ID NO: 26608
  hemagglutinin__InfluenzaB__AGX20855

SEQ ID NO: 27442 - protein, 585 aa, Artificial Sequence; identical to SEQ ID NO: 26683
  hemagglutinin__InfluenzaB__AGX20866

SEQ ID NO: 27443 - protein, 585 aa, Artificial Sequence; identical to SEQ ID NO: 26683
  hemagglutinin__InfluenzaB__AGX20877

SEQ ID NO: 27444 - protein, 585 aa, Artificial Sequence
  hemagglutinin__InfluenzaB__AGX20888
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27445 - protein, 585 aa, Artificial Sequence; identical to SEQ ID NO: 26683
  hemagglutinin__InfluenzaB__AGX20899

SEQ ID NO: 27446 - protein, 585 aa, Artificial Sequence; identical to SEQ ID NO: 26683
  hemagglutinin__InfluenzaB__AGX20910

SEQ ID NO: 27447 - protein, 585 aa, Artificial Sequence; identical to SEQ ID NO: 26608
  hemagglutinin__InfluenzaB__AGX20921

SEQ ID NO: 27448 - protein, 585 aa, Artificial Sequence
  hemagglutinin__InfluenzaB__AGX20932
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDPKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27449 - protein, 585 aa, Artificial Sequence; identical to SEQ ID NO: 26608
  hemagglutinin__InfluenzaB__AGX20943

SEQ ID NO: 27450 - protein, 585 aa, Artificial Sequence; identical to SEQ ID NO: 26608
  hemagglutinin__InfluenzaB__AGX20954

SEQ ID NO: 27451 - protein, 585 aa, Artificial Sequence; identical to SEQ ID NO: 26608
  hemagglutinin__InfluenzaB__AGX20965

SEQ ID NO: 27452 - protein, 585 aa, Artificial Sequence
  hemagglutinin__InfluenzaB__AGX20976
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHGEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27453 - protein, 585 aa, Artificial Sequence; identical to SEQ ID NO: 26608
  hemagglutinin__InfluenzaB__AGX20987

SEQ ID NO: 27454 - protein, 585 aa, Artificial Sequence; identical to SEQ ID NO: 26683
  hemagglutinin__InfluenzaB__AGX20998

SEQ ID NO: 27455 - protein, 585 aa, Artificial Sequence
  hemagglutinin__InfluenzaB__AGX21009
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMISRDNVSCSICL

SEQ ID NO: 27456 - protein, 585 aa, Artificial Sequence
  hemagglutinin__InfluenzaB__AGX21020
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSEPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27457 - protein, 585 aa, Artificial Sequence; identical to SEQ ID NO: 26683
  hemagglutinin__InfluenzaB__AGX21031

SEQ ID NO: 27458 - protein, 585 aa, Artificial Sequence
  hemagglutinin__InfluenzaB__AGX21042
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINTENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27459 - protein, 585 aa, Artificial Sequence; identical to SEQ ID NO: 26645
  hemagglutinin__InfluenzaB__AGX21053

SEQ ID NO: 27460 - protein, 585 aa, Artificial Sequence; identical to SEQ ID NO: 26608
  hemagglutinin__InfluenzaB__AGX21064

SEQ ID NO: 27461 - protein, 585 aa, Artificial Sequence; identical to SEQ ID NO: 26645
  hemagglutinin__InfluenzaB__AGX21075

SEQ ID NO: 27462 - protein, 585 aa, Artificial Sequence; identical to SEQ ID NO: 26645
  hemagglutinin__InfluenzaB__AGX21084

SEQ ID NO: 27463 - protein, 585 aa, Artificial Sequence; identical to SEQ ID NO: 26645
  hemagglutinin__InfluenzaB__AGX21095

SEQ ID NO: 27464 - protein, 585 aa, Artificial Sequence
  hemagglutinin__InfluenzaB__AGX21106
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27465 - protein, 585 aa, Artificial Sequence; identical to SEQ ID NO: 26608
  hemagglutinin__InfluenzaB__AGX21117

SEQ ID NO: 27466 - protein, 585 aa, Artificial Sequence; identical to SEQ ID NO: 27458
  hemagglutinin__InfluenzaB__AGX21128

SEQ ID NO: 27467 - protein, 585 aa, Artificial Sequence
  hemagglutinin__InfluenzaB__AGX21139
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGDFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27468 - protein, 585 aa, Artificial Sequence; identical to SEQ ID NO: 26683
  hemagglutinin__InfluenzaB__AGX21150

SEQ ID NO: 27469 - protein, 585 aa, Artificial Sequence; identical to SEQ ID NO: 26608
  hemagglutinin__InfluenzaB__AGX21161

SEQ ID NO: 27470 - protein, 585 aa, Artificial Sequence; identical to SEQ ID NO: 26683
  hemagglutinin__InfluenzaB__AGX21172

SEQ ID NO: 27471 - protein, 585 aa, Artificial Sequence; identical to SEQ ID NO: 26645
  hemagglutinin__InfluenzaB__AGX21183

SEQ ID NO: 27472 - protein, 585 aa, Artificial Sequence; identical to SEQ ID NO: 26683
  hemagglutinin__InfluenzaB__AGX21194

SEQ ID NO: 27473 - protein, 585 aa, Artificial Sequence
  hemagglutinin__InfluenzaB__AGX21205
MKAIIVLLMVVTSNADRICTGITSSNSPHIVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAKNAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27474 - protein, 585 aa, Artificial Sequence; identical to SEQ ID NO: 26645
  hemagglutinin__InfluenzaB__AGX21216

SEQ ID NO: 27475 - protein, 585 aa, Artificial Sequence; identical to SEQ ID NO: 26608
  hemagglutinin__InfluenzaB__AGX21227

SEQ ID NO: 27476 - protein, 585 aa, Artificial Sequence
  hemagglutinin__InfluenzaB__AGX21238
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCANGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMISRDNVSCSICL

SEQ ID NO: 27477 - protein, 585 aa, Artificial Sequence; identical to SEQ ID NO: 26683
  hemagglutinin__InfluenzaB__AGX21249

SEQ ID NO: 27478 - protein, 585 aa, Artificial Sequence
  hemagglutinin__InfluenzaB__AGX21260
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQRVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27479 - protein, 585 aa, Artificial Sequence; identical to SEQ ID NO: 26608
  hemagglutinin__InfluenzaB__AGX21271

SEQ ID NO: 27480 - protein, 585 aa, Artificial Sequence
  hemagglutinin__InfluenzaB__AGX21282
MKAIIVLLMVVTSNADRICTGITSSNSPHIVKTATQGEVNVTGVIPLTTSPTKSHFANLKGTETRGKLCPKCLNCTDLDVALGRPKCTGKIPSARVSILHEVRPVTSGCFPIMHDRTKIRQLPNLLRGYEHIRLSTHNVINAKNAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27481 - protein, 585 aa, Artificial Sequence; identical to SEQ ID NO: 26645
  hemagglutinin__InfluenzaB__AGX21293

SEQ ID NO: 27482 - protein, 585 aa, Artificial Sequence; identical to SEQ ID NO: 26683
  hemagglutinin__InfluenzaB__AGX21304

SEQ ID NO: 27483 - protein, 585 aa, Artificial Sequence; identical to SEQ ID NO: 26645
  hemagglutinin__InfluenzaB__AGX21315

SEQ ID NO: 27484 - protein, 585 aa, Artificial Sequence; identical to SEQ ID NO: 26608
  hemagglutinin__InfluenzaB__AGX21326

SEQ ID NO: 27485 - protein, 585 aa, Artificial Sequence
  hemagglutinin__InfluenzaB__AGX21337
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDKETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27486 - protein, 585 aa, Artificial Sequence; identical to SEQ ID NO: 26645
  hemagglutinin__InfluenzaB__AGX21348

SEQ ID NO: 27487 - protein, 585 aa, Artificial Sequence; identical to SEQ ID NO: 26645
  hemagglutinin__InfluenzaB__AGX21359

SEQ ID NO: 27488 - protein, 585 aa, Artificial Sequence
  hemagglutinin__InfluenzaB__AGX21370
MKAIIVLLMVVTSNADRICTGITSSNSPHVVKTATQGEVNVTGVIPLTTTPTKSHFANLKGTETRGKLCPKCPNCTDLDVALGRPKCMGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27489 - protein, 585 aa, Artificial Sequence
  hemagglutinin__InfluenzaB__AGX21381
MKAIIVLLMVVTSNADRICTGITSSNSPHIVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYISQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27490 - protein, 585 aa, Artificial Sequence
  hemagglutinin__InfluenzaB__AGX21392
MKAIIVLLMVVTSNADRICTGITSSNSPHIVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27491 - protein, 585 aa, Artificial Sequence
  hemagglutinin__InfluenzaB__AGX21403
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLNRIAAGTFDAGEFSLPTFDSLNITAASLNDDGLDNHTILLYYSTAASSLAVTLMIAIFVVYMVSRDNVSCSICL

SEQ ID NO: 27492 - protein, 585 aa, Artificial Sequence
  hemagglutinin__InfluenzaB__AGX21414
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATDPLTIEVPYICTEGEDQITVWGFHSDNETQMAKLYGDSKPQKFTSSSNGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27493 - protein, 585 aa, Artificial Sequence; identical to SEQ ID NO: 26608
  hemagglutinin__InfluenzaB__AGX21425

SEQ ID NO: 27494 - protein, 585 aa, Artificial Sequence
  hemagglutinin__InfluenzaB__AGX21436
MKAIIVLLMVVTSNADRICTGITSSNSPHIVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTVASSLAVTLMIAIFVVYMVSRDNVSCSICL

SEQ ID NO: 27495 - protein, 585 aa, Artificial Sequence; identical to SEQ ID NO: 26683
  hemagglutinin__InfluenzaB__AGX21447

SEQ ID NO: 27496 - protein, 585 aa, Artificial Sequence; identical to SEQ ID NO: 26608
  hemagglutinin__InfluenzaB__AGX21458

SEQ ID NO: 27497 - protein, 585 aa, Artificial Sequence; identical to SEQ ID NO: 26608
  hemagglutinin__InfluenzaB__AGX21469

SEQ ID NO: 27498 - protein, 585 aa, Artificial Sequence
  hemagglutinin__InfluenzaB__AGX21480
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNEDGLDNHTILLYYSTAASSLAVTLMIAIFVVYMVSRDNVSCSICL

SEQ ID NO: 27499 - protein, 585 aa, Artificial Sequence; identical to SEQ ID NO: 26683
  hemagglutinin__InfluenzaB__AGX21491

SEQ ID NO: 27500 - protein, 585 aa, Artificial Sequence; identical to SEQ ID NO: 26683
  hemagglutinin__InfluenzaB__AGX21502

SEQ ID NO: 27501 - protein, 585 aa, Artificial Sequence; identical to SEQ ID NO: 26608
  hemagglutinin__InfluenzaB__AGX21513

SEQ ID NO: 27502 - protein, 585 aa, Artificial Sequence; identical to SEQ ID NO: 26645
  hemagglutinin__InfluenzaB__AGX21524

SEQ ID NO: 27503 - protein, 585 aa, Artificial Sequence
  hemagglutinin__InfluenzaB__AGX21535
MKAIIVLLMVVTSNADRICTGITSSNSPHIVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27504 - protein, 585 aa, Artificial Sequence; identical to SEQ ID NO: 26645
  hemagglutinin__InfluenzaB__AGX21546

SEQ ID NO: 27505 - protein, 585 aa, Artificial Sequence
  hemagglutinin__InfluenzaB__AGX21557
MKAIIVLLMVVTSNADRICTGITSSNSPHVVKTATQGEVNVTGVITLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27506 - protein, 585 aa, Artificial Sequence
  hemagglutinin__InfluenzaB__AGX21568
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPMMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27507 - protein, 585 aa, Artificial Sequence; identical to SEQ ID NO: 26608
  hemagglutinin__InfluenzaB__AGX21579

SEQ ID NO: 27508 - protein, 585 aa, Artificial Sequence; identical to SEQ ID NO: 26645
  hemagglutinin__InfluenzaB__AGX21590

SEQ ID NO: 27509 - protein, 585 aa, Artificial Sequence; identical to SEQ ID NO: 27458
  hemagglutinin__InfluenzaB__AGX21601

SEQ ID NO: 27510 - protein, 585 aa, Artificial Sequence; identical to SEQ ID NO: 26645
  hemagglutinin__InfluenzaB__AGX21611

SEQ ID NO: 27511 - protein, 585 aa, Artificial Sequence; identical to SEQ ID NO: 26989
  hemagglutinin__InfluenzaB__AGX21622

SEQ ID NO: 27512 - protein, 585 aa, Artificial Sequence
  hemagglutinin__InfluenzaB__AGX21633
MKAIIVLLMVVTSNADRICTGITSSNSPHIVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPARLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27513 - protein, 585 aa, Artificial Sequence; identical to SEQ ID NO: 26683
  hemagglutinin__InfluenzaB__AGX21644

SEQ ID NO: 27514 - protein, 585 aa, Artificial Sequence; identical to SEQ ID NO: 26608
  hemagglutinin__InfluenzaB__AGX21655

SEQ ID NO: 27515 - protein, 585 aa, Artificial Sequence
  hemagglutinin__InfluenzaB__AGX21666
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDKIAAGTFDAGEFSLPTFDSLNITAASLNDDGLDNHTILLYYSTAASSLAVTLMIAIFVVYMVSRDNVSCSICL

SEQ ID NO: 27516 - protein, 585 aa, Artificial Sequence; identical to SEQ ID NO: 26683
  hemagglutinin__InfluenzaB__AGX21677

SEQ ID NO: 27517 - protein, 585 aa, Artificial Sequence; identical to SEQ ID NO: 26608
  hemagglutinin__InfluenzaB__AGX21688

SEQ ID NO: 27518 - protein, 585 aa, Artificial Sequence
  hemagglutinin__InfluenzaB__AGX21699
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLNLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLSDDGLDNHTILLYYSTAASSLAVTLMIAIFVVYMVSRDNVSCSICL

SEQ ID NO: 27519 - protein, 585 aa, Artificial Sequence; identical to SEQ ID NO: 27458
  hemagglutinin__InfluenzaB__AGX21710

SEQ ID NO: 27520 - protein, 585 aa, Artificial Sequence; identical to SEQ ID NO: 26683
  hemagglutinin__InfluenzaB__AGX21721

SEQ ID NO: 27521 - protein, 584 aa, Artificial Sequence
  hemagglutinin__InfluenzaB__AGX21732
MKAIIVLLMVVTSNADRICTGITSSNSPHVVKTATQGEVNVTGAIPLTTTPTKSHFANLKGTKTRGKLCPTCLNCTDLDVALGGPMCVGITPSAKASILHEVRPVTSGCFPIMHDRTKIRQLPNLLRGYEKIRLSAQNVINAEKAPGGPYKLGTSGSCPNATSKSGFFATMAWAVPRDDNKTATNPLTVEVPHICANEEDQITVWGFHSDNKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 27522 - protein, 584 aa, Artificial Sequence
  hemagglutinin__InfluenzaB__AGX21743
MKAIIVLLMVVTSNADRICTGITSSNSPHVVKTATQGEVNVTGVIPLTTTPTKSHFANLKGTRTRGKLCPDCLNCTDLDVALGRPMCVGTTPSAKASILHEVRPVTSGCFPIMHDRTKIRQLPNLLRGYENIRLSTQNVIDAEKALGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMVQKPGKTGTIVYQRGVLLPQKVWCASGKSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27523 - protein, 584 aa, Artificial Sequence
  hemagglutinin__InfluenzaB__AGX21754
MKAIIVLLMVVTSNADRICTGITSSNSPHVVKTATQGEVNVTGAIPLTTTPAKSHFANLKGTKTRGKLCPTCLNCTDLDVALGGPMCVGITPSAKASILHEVRPVTSGCFPIMHDRTKIRQLPNLLRGYEKIRLSAQNVINAEKAPGGPYKLGTSGSCPNATSKSGFFATMAWAVPRDDNKTATNPLTVEVPHICANEEDQITVWGFHSDNKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 27524 - protein, 584 aa, Artificial Sequence
  hemagglutinin__InfluenzaB__AGX21776
MKAIIVLLMVVTSNADRICTGITSSNSPHVVKTATQGEVNVTGVIPLTTTPTKSYFANLKGTRTRGKLCPDCLNCTDLDVALGRPMCVGITPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYVCTEGEDQITVWGFHSDNKTQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27525 - protein, 585 aa, Artificial Sequence; identical to SEQ ID NO: 26979
  hemagglutinin__InfluenzaB__AGX21787

SEQ ID NO: 27526 - protein, 584 aa, Artificial Sequence
  hemagglutinin__InfluenzaB__AGX21798
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYVCTEGEDQITVWGFHSDNKTQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27527 - protein, 584 aa, Artificial Sequence
  hemagglutinin__InfluenzaB__AGX21809
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYVCTEGEDQITVWGFHSDNKTQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSRPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27528 - protein, 584 aa, Artificial Sequence
  hemagglutinin__InfluenzaB__AGX21820
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATNKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27529 - protein, 584 aa, Artificial Sequence; identical to SEQ ID NO: 27023
  hemagglutinin__InfluenzaB__AGX21831

SEQ ID NO: 27530 - protein, 584 aa, Artificial Sequence; identical to SEQ ID NO: 27026
  hemagglutinin__InfluenzaB__AGX21842

SEQ ID NO: 27531 - protein, 584 aa, Artificial Sequence; identical to SEQ ID NO: 27026
  hemagglutinin__InfluenzaB__AGX21853

SEQ ID NO: 27532 - protein, 584 aa, Artificial Sequence
  hemagglutinin__InfluenzaB__AGX21864
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSNQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27533 - protein, 584 aa, Artificial Sequence; identical to SEQ ID NO: 27024
  hemagglutinin__InfluenzaB__AGX21875

SEQ ID NO: 27534 - protein, 584 aa, Artificial Sequence; identical to SEQ ID NO: 27023
  hemagglutinin__InfluenzaB__AGX21886

SEQ ID NO: 27535 - protein, 584 aa, Artificial Sequence; identical to SEQ ID NO: 27023
  hemagglutinin__InfluenzaB__AGX21897

SEQ ID NO: 27536 - protein, 584 aa, Artificial Sequence; identical to SEQ ID NO: 27023
  hemagglutinin__InfluenzaB__AGX21908

SEQ ID NO: 27537 - protein, 584 aa, Artificial Sequence
  hemagglutinin__InfluenzaB__AGX21919
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKAGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27538 - protein, 584 aa, Artificial Sequence; identical to SEQ ID NO: 27026
  hemagglutinin__InfluenzaB__AGX21941

SEQ ID NO: 27539 - protein, 584 aa, Artificial Sequence; identical to SEQ ID NO: 27023
  hemagglutinin__InfluenzaB__AGX21952

SEQ ID NO: 27540 - protein, 584 aa, Artificial Sequence; identical to SEQ ID NO: 27026
  hemagglutinin__InfluenzaB__AGX21963

SEQ ID NO: 27541 - protein, 584 aa, Artificial Sequence
  hemagglutinin__InfluenzaB__AGX21974
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKVNNKNATNPLTVEVPYICTEGEDQITVWGFHSDNKTQMKNLYGDSNPQKFTSSANGVTTHYVSQIGSFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMISRDNVSCSICL

SEQ ID NO: 27542 - protein, 584 aa, Artificial Sequence; identical to SEQ ID NO: 27026
  hemagglutinin__InfluenzaB__AGX21985

SEQ ID NO: 27543 - protein, 584 aa, Artificial Sequence; identical to SEQ ID NO: 27024
  hemagglutinin__InfluenzaB__AGX21996

SEQ ID NO: 27544 - protein, 584 aa, Artificial Sequence; identical to SEQ ID NO: 27024
  hemagglutinin__InfluenzaB__AGX22007

SEQ ID NO: 27545 - protein, 584 aa, Artificial Sequence; identical to SEQ ID NO: 27023
  hemagglutinin__InfluenzaB__AGX22018

SEQ ID NO: 27546 - protein, 584 aa, Artificial Sequence; identical to SEQ ID NO: 27023
  hemagglutinin__InfluenzaB__AGX22029

SEQ ID NO: 27547 - protein, 584 aa, Artificial Sequence; identical to SEQ ID NO: 27023
  hemagglutinin__InfluenzaB__AGX22040

SEQ ID NO: 27548 - protein, 584 aa, Artificial Sequence
  hemagglutinin__InfluenzaB__AGX22051
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQIEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDALHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27549 - protein, 584 aa, Artificial Sequence; identical to SEQ ID NO: 27023
  hemagglutinin__InfluenzaB__AGX22062

SEQ ID NO: 27550 - protein, 584 aa, Artificial Sequence
  hemagglutinin__InfluenzaB__AGX22073
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFIEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGDFSLPTFDSLNITAASLNDDGLDNHTILLYYSTAASSLAVTLMLAIFIVYMVSRDNVSCSICL

SEQ ID NO: 27551 - protein, 584 aa, Artificial Sequence; identical to SEQ ID NO: 27026
  hemagglutinin__InfluenzaB__AGX22095

SEQ ID NO: 27552 - protein, 584 aa, Artificial Sequence; identical to SEQ ID NO: 27024
  hemagglutinin__InfluenzaB__AGX22106

SEQ ID NO: 27553 - protein, 584 aa, Artificial Sequence
  hemagglutinin__InfluenzaB__AGX22128
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAENAPGGPYRLGTSGSCPNATSKSGFFATMAWAVPKDNNKNATNPLTVEVPYVCTEGEDQITVWGFHSDNKTQMKNLYGDSNPQKFTSSANGVTTHYVSQIGGFPAQTEDGGLPQSGRIVVDYMVQKPRKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEIKNLQRLSGAMNELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27554 - protein, 584 aa, Artificial Sequence
  hemagglutinin__InfluenzaB__AGX22139
MKAIIVLLMVVTSNADRICTGITSSNSPHVVKTATQGEVNVTGVIPLTTTPTKSYFANLKGTRTRGKLCPDCLNCTDLDVALGRPMCVGTTPSAEASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27555 - protein, 584 aa, Artificial Sequence; identical to SEQ ID NO: 27554
  hemagglutinin__InfluenzaB__AGX22150

SEQ ID NO: 27556 - protein, 584 aa, Artificial Sequence; identical to SEQ ID NO: 27554
  hemagglutinin__InfluenzaB__AGX22161

SEQ ID NO: 27557 - protein, 584 aa, Artificial Sequence; identical to SEQ ID NO: 27023
  hemagglutinin__InfluenzaB__AGX22172

SEQ ID NO: 27558 - protein, 584 aa, Artificial Sequence; identical to SEQ ID NO: 27554
  hemagglutinin__InfluenzaB__AGX22183

SEQ ID NO: 27559 - protein, 584 aa, Artificial Sequence; identical to SEQ ID NO: 27554
  hemagglutinin__InfluenzaB__AGX22194

SEQ ID NO: 27560 - protein, 584 aa, Artificial Sequence; identical to SEQ ID NO: 27554
  hemagglutinin__InfluenzaB__AGX22205

SEQ ID NO: 27561 - protein, 584 aa, Artificial Sequence; identical to SEQ ID NO: 27024
  hemagglutinin__InfluenzaB__AGX22216

SEQ ID NO: 27562 - protein, 584 aa, Artificial Sequence; identical to SEQ ID NO: 27026
  hemagglutinin__InfluenzaB__AGX22227

SEQ ID NO: 27563 - protein, 584 aa, Artificial Sequence
  hemagglutinin__InfluenzaB__AGX22238
MKAIIVLLMVVTSNADRICTGITSSNSPHMVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27564 - protein, 584 aa, Artificial Sequence; identical to SEQ ID NO: 27024
  hemagglutinin__InfluenzaB__AGX22249

SEQ ID NO: 27565 - protein, 584 aa, Artificial Sequence; identical to SEQ ID NO: 27023
  hemagglutinin__InfluenzaB__AGX22260

SEQ ID NO: 27566 - protein, 584 aa, Artificial Sequence
  hemagglutinin__InfluenzaB__AGX22271
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPSAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27567 - protein, 584 aa, Artificial Sequence
  hemagglutinin__InfluenzaB__AGX22282
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27568 - protein, 584 aa, Artificial Sequence; identical to SEQ ID NO: 27023
  hemagglutinin__InfluenzaB__AGX22293

SEQ ID NO: 27569 - protein, 584 aa, Artificial Sequence
  hemagglutinin__InfluenzaB__AGX22304
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSTNGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27570 - protein, 584 aa, Artificial Sequence; identical to SEQ ID NO: 27023
  hemagglutinin__InfluenzaB__AGX22315

SEQ ID NO: 27571 - protein, 584 aa, Artificial Sequence; identical to SEQ ID NO: 26426
  hemagglutinin__InfluenzaB__AGX22326

SEQ ID NO: 27572 - protein, 584 aa, Artificial Sequence; identical to SEQ ID NO: 27026
  hemagglutinin__InfluenzaB__AGX22337

SEQ ID NO: 27573 - protein, 584 aa, Artificial Sequence; identical to SEQ ID NO: 27026
  hemagglutinin__InfluenzaB__AGX22348

SEQ ID NO: 27574 - protein, 584 aa, Artificial Sequence
  hemagglutinin__InfluenzaB__AGX22359
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAENAPGGPYRLGTSGSCPNATSKSGFFATMAWAVPKDNNKNATNPLTVEVPYVCTEGEDQITVWGFHSDNKTQMKNLYGDSNPQKFTSSANGVTTHYVSQIGGFPAQTEDGGLPQSGRIVVDYMVQKPKKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEIKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27575 - protein, 584 aa, Artificial Sequence; identical to SEQ ID NO: 27024
  hemagglutinin__InfluenzaB__AGX22370

SEQ ID NO: 27576 - protein, 584 aa, Artificial Sequence
  hemagglutinin__InfluenzaB__AGX22381
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLSNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27577 - protein, 584 aa, Artificial Sequence; identical to SEQ ID NO: 27023
  hemagglutinin__InfluenzaB__AGX22392

SEQ ID NO: 27578 - protein, 584 aa, Artificial Sequence
  hemagglutinin__InfluenzaB__AGX22403
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGDFSLPTFDSLNITAASLNDDGLDNHTILLYYSTAASSLAVTLMLAIFIVYMVSRDNVSCSICL

SEQ ID NO: 27579 - protein, 584 aa, Artificial Sequence; identical to SEQ ID NO: 27023
  hemagglutinin__InfluenzaB__AGX22414

SEQ ID NO: 27580 - protein, 584 aa, Artificial Sequence
  hemagglutinin__InfluenzaB__AGX22425
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKIQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27581 - protein, 584 aa, Artificial Sequence; identical to SEQ ID NO: 27024
  hemagglutinin__InfluenzaB__AGX22436

SEQ ID NO: 27582 - protein, 584 aa, Artificial Sequence; identical to SEQ ID NO: 27024
  hemagglutinin__InfluenzaB__AGX22445

SEQ ID NO: 27583 - protein, 584 aa, Artificial Sequence
  hemagglutinin__InfluenzaB__AGX22456
MKAIIVLLMVVTSNADRICTGITSSSSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHSEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYIVSRDNVSCSICL

SEQ ID NO: 27584 - protein, 584 aa, Artificial Sequence; identical to SEQ ID NO: 27023
  hemagglutinin__InfluenzaB__AGX22467

SEQ ID NO: 27585 - protein, 584 aa, Artificial Sequence; identical to SEQ ID NO: 27023
  hemagglutinin__InfluenzaB__AGX22478

SEQ ID NO: 27586 - protein, 584 aa, Artificial Sequence
  hemagglutinin__InfluenzaB__AGX22489
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQSAIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPGQTEDGGLPQSGRIVVDYMIQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISAQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27587 - protein, 584 aa, Artificial Sequence
  hemagglutinin__InfluenzaB__AGX22500
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAENAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPAQTEDGGLPQSGRIIVDYMVQKPRKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTVASSLAVTLMLAIFIVYMVSRDNVSCSICL

SEQ ID NO: 27588 - protein, 584 aa, Artificial Sequence; identical to SEQ ID NO: 27024
  hemagglutinin__InfluenzaB__AGX22511

SEQ ID NO: 27589 - protein, 584 aa, Artificial Sequence
  hemagglutinin__InfluenzaB__AGX22522
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTKHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27590 - protein, 584 aa, Artificial Sequence; identical to SEQ ID NO: 26426
  hemagglutinin__InfluenzaB__AGX22533

SEQ ID NO: 27591 - protein, 584 aa, Artificial Sequence; identical to SEQ ID NO: 27038
  hemagglutinin__InfluenzaB__AGX22566

SEQ ID NO: 27592 - protein, 584 aa, Artificial Sequence; identical to SEQ ID NO: 27024
  hemagglutinin__InfluenzaB__AGX22577

SEQ ID NO: 27593 - protein, 584 aa, Artificial Sequence; identical to SEQ ID NO: 27038
  hemagglutinin__InfluenzaB__AGX22588

SEQ ID NO: 27594 - protein, 584 aa, Artificial Sequence; identical to SEQ ID NO: 26426
  hemagglutinin__InfluenzaB__AGX22599

SEQ ID NO: 27595 - protein, 584 aa, Artificial Sequence
  hemagglutinin__InfluenzaB__AGX22610
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDPNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27596 - protein, 584 aa, Artificial Sequence
  hemagglutinin__InfluenzaB__AGX22621
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTGGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27597 - protein, 584 aa, Artificial Sequence; identical to SEQ ID NO: 26426
  hemagglutinin__InfluenzaB__AGX22632

SEQ ID NO: 27598 - protein, 584 aa, Artificial Sequence
  hemagglutinin__InfluenzaB__AGX22643
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSIQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27599 - protein, 584 aa, Artificial Sequence
  hemagglutinin__InfluenzaB__AGX22654
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHSEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27600 - protein, 584 aa, Artificial Sequence; identical to SEQ ID NO: 27038
  hemagglutinin__InfluenzaB__AGX22665

SEQ ID NO: 27601 - protein, 584 aa, Artificial Sequence; identical to SEQ ID NO: 27038
  hemagglutinin__InfluenzaB__AGX22676

SEQ ID NO: 27602 - protein, 584 aa, Artificial Sequence; identical to SEQ ID NO: 26426
  hemagglutinin__InfluenzaB__AGX22687

SEQ ID NO: 27603 - protein, 584 aa, Artificial Sequence; identical to SEQ ID NO: 27038
  hemagglutinin__InfluenzaB__AGX22698

SEQ ID NO: 27604 - protein, 584 aa, Artificial Sequence
  hemagglutinin__InfluenzaB__AGX22709
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPEKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27605 - protein, 584 aa, Artificial Sequence
  hemagglutinin__InfluenzaB__AGX22720
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGATTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27606 - protein, 584 aa, Artificial Sequence; identical to SEQ ID NO: 27038
  hemagglutinin__InfluenzaB__AGX22731

SEQ ID NO: 27607 - protein, 584 aa, Artificial Sequence; identical to SEQ ID NO: 27599
  hemagglutinin__InfluenzaB__AGX22742

SEQ ID NO: 27608 - protein, 584 aa, Artificial Sequence
  hemagglutinin__InfluenzaB__AGX22753
MKAIIVLLMVVTSNADRICTGITSSNSPHVVKTATQGEVNVTGVIPLTTTPAKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICKEGEDQITVWGFHSDNKTQMKNLYGDSNPQKFTSSANGVTTHYVSQIGGFPDQTEDGGLPQSGRIVVDYMIQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27609 - protein, 584 aa, Artificial Sequence
  hemagglutinin__InfluenzaB__AGX22764
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICKEGEDQITVWGFHSDNKTQMKNLYGDSNPQKFTSSANGVTTHYVSQIGGFPDQTEDGGLPQSGRIVVDYMIQKPGKTGTIVYQRGVLLPQKVWCASGRSKVIKGSLPLIGEADCLHEKYGGLNKSKPYYTGDHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27610 - protein, 584 aa, Artificial Sequence
  hemagglutinin__InfluenzaB__AGX22775
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERRLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27611 - protein, 584 aa, Artificial Sequence; identical to SEQ ID NO: 27038
  hemagglutinin__InfluenzaB__AGX22786

SEQ ID NO: 27612 - protein, 584 aa, Artificial Sequence
  hemagglutinin__InfluenzaB__AGX22797
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICKEGEDQITVWGFHSDNKTQMKNLYGDSNPQKFTSSANGVTTHYVSQIGGFPDQTEDGGLPQSGRIVVDYMIQKPGKTGTIVYQRGVLFPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27613 - protein, 584 aa, Artificial Sequence; identical to SEQ ID NO: 27038
  hemagglutinin__InfluenzaB__AGX22808

SEQ ID NO: 27614 - protein, 584 aa, Artificial Sequence; identical to SEQ ID NO: 27038
  hemagglutinin__InfluenzaB__AGX22819

SEQ ID NO: 27615 - protein, 584 aa, Artificial Sequence; identical to SEQ ID NO: 27038
  hemagglutinin__InfluenzaB__AGX22830

SEQ ID NO: 27616 - protein, 584 aa, Artificial Sequence
  hemagglutinin__InfluenzaB__AGX22841
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICKEGEDQITVWGFHSDNKTQMKNLYGDSNPQKFTSSADGVTTHYVSQIGGFPDQTEDGGLPQSGRIVVDYMIQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27617 - protein, 584 aa, Artificial Sequence; identical to SEQ ID NO: 26426
  hemagglutinin__InfluenzaB__AGX22852

SEQ ID NO: 27618 - protein, 584 aa, Artificial Sequence; identical to SEQ ID NO: 27038
  hemagglutinin__InfluenzaB__AGX22863

SEQ ID NO: 27619 - protein, 584 aa, Artificial Sequence; identical to SEQ ID NO: 27038
  hemagglutinin__InfluenzaB__AGX22874

SEQ ID NO: 27620 - protein, 584 aa, Artificial Sequence; identical to SEQ ID NO: 26426
  hemagglutinin__InfluenzaB__AGX22885

SEQ ID NO: 27621 - protein, 584 aa, Artificial Sequence; identical to SEQ ID NO: 27599
  hemagglutinin__InfluenzaB__AGX22896

SEQ ID NO: 27622 - protein, 584 aa, Artificial Sequence
  hemagglutinin__InfluenzaB__AGX22907
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDSVSCSICL

SEQ ID NO: 27623 - protein, 584 aa, Artificial Sequence; identical to SEQ ID NO: 26426
  hemagglutinin__InfluenzaB__AGX22918

SEQ ID NO: 27624 - protein, 584 aa, Artificial Sequence; identical to SEQ ID NO: 26426
  hemagglutinin__InfluenzaB__AGX22929

SEQ ID NO: 27625 - protein, 584 aa, Artificial Sequence; identical to SEQ ID NO: 27038
  hemagglutinin__InfluenzaB__AGX22940

SEQ ID NO: 27626 - protein, 584 aa, Artificial Sequence; identical to SEQ ID NO: 26426
  hemagglutinin__InfluenzaB__AGX22951

SEQ ID NO: 27627 - protein, 584 aa, Artificial Sequence; identical to SEQ ID NO: 26426
  hemagglutinin__InfluenzaB__AGX22962

SEQ ID NO: 27628 - protein, 584 aa, Artificial Sequence; identical to SEQ ID NO: 26426
  hemagglutinin__InfluenzaB__AGX22973

SEQ ID NO: 27629 - protein, 584 aa, Artificial Sequence; identical to SEQ ID NO: 26426
  hemagglutinin__InfluenzaB__AGX22984

SEQ ID NO: 27630 - protein, 584 aa, Artificial Sequence; identical to SEQ ID NO: 26426
  hemagglutinin__InfluenzaB__AGX22995

SEQ ID NO: 27631 - protein, 584 aa, Artificial Sequence; identical to SEQ ID NO: 26426
  hemagglutinin__InfluenzaB__AGX23006

SEQ ID NO: 27632 - protein, 584 aa, Artificial Sequence
  hemagglutinin__InfluenzaB__AGX23017
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEIRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27633 - protein, 584 aa, Artificial Sequence
  hemagglutinin__InfluenzaB__AGX23028
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYKLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27634 - protein, 584 aa, Artificial Sequence; identical to SEQ ID NO: 26426
  hemagglutinin__InfluenzaB__AGX23039

SEQ ID NO: 27635 - protein, 584 aa, Artificial Sequence
  hemagglutinin__InfluenzaB__AGX23050
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVSPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLRLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27636 - protein, 584 aa, Artificial Sequence
  hemagglutinin__InfluenzaB__AGX23061
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLRLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27637 - protein, 584 aa, Artificial Sequence; identical to SEQ ID NO: 26426
  hemagglutinin__InfluenzaB__AGX23072

SEQ ID NO: 27638 - protein, 584 aa, Artificial Sequence; identical to SEQ ID NO: 27038
  hemagglutinin__InfluenzaB__AGX23083

SEQ ID NO: 27639 - protein, 584 aa, Artificial Sequence; identical to SEQ ID NO: 26426
  hemagglutinin__InfluenzaB__AGX23094

SEQ ID NO: 27640 - protein, 584 aa, Artificial Sequence; identical to SEQ ID NO: 26426
  hemagglutinin__InfluenzaB__AGX23105

SEQ ID NO: 27641 - protein, 584 aa, Artificial Sequence; identical to SEQ ID NO: 27038
  hemagglutinin__InfluenzaB__AGX23116

SEQ ID NO: 27642 - protein, 584 aa, Artificial Sequence; identical to SEQ ID NO: 26426
  hemagglutinin__InfluenzaB__AGX23127

SEQ ID NO: 27643 - protein, 584 aa, Artificial Sequence; identical to SEQ ID NO: 26426
  hemagglutinin__InfluenzaB__AGX23138

SEQ ID NO: 27644 - protein, 584 aa, Artificial Sequence
  hemagglutinin__InfluenzaB__AGX23149
MKAIIVLLMVVTSNADRICTGITSSDSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27645 - protein, 584 aa, Artificial Sequence
  hemagglutinin__InfluenzaB__AGX23160
MKAIIVLLMVVTSNADRICTGITSSNSPHVVKTATQGEVNVTGVIPLTTTPTKSYFANLKGTRTRGKLCPDCLNCTDLDVALGRPMCVGITPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQRFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLRLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27646 - protein, 584 aa, Artificial Sequence
  hemagglutinin__InfluenzaB__AGX23171
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQRFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLRLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27647 - protein, 584 aa, Artificial Sequence; identical to SEQ ID NO: 26426
  hemagglutinin__InfluenzaB__AGX23182

SEQ ID NO: 27648 - protein, 584 aa, Artificial Sequence; identical to SEQ ID NO: 26426
  hemagglutinin__InfluenzaB__AGX23193

SEQ ID NO: 27649 - protein, 584 aa, Artificial Sequence; identical to SEQ ID NO: 27038
  hemagglutinin__InfluenzaB__AGX23204

SEQ ID NO: 27650 - protein, 584 aa, Artificial Sequence; identical to SEQ ID NO: 26426
  hemagglutinin__InfluenzaB__AGX23215

SEQ ID NO: 27651 - protein, 584 aa, Artificial Sequence
  hemagglutinin__InfluenzaB__AGX23226
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICKEGEDQITVWGFHSDNKTQMKNLYGDSNPQKFTSSASGVTTHYVSQIGGFPDQTEDGGLPQSGRIVVDYMIQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27652 - protein, 584 aa, Artificial Sequence; identical to SEQ ID NO: 27599
  hemagglutinin__InfluenzaB__AGX23237

SEQ ID NO: 27653 - protein, 584 aa, Artificial Sequence
  hemagglutinin__InfluenzaB__AGX23248
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICKEGEDQITVWGFHSDNKTQMKNLYGDSNPQKFTSSASGVTTHYVSQIGGFPDQTEDGGLPQSGRIVVDYMIQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLNRIAAGTFNAGEFSLPTFDSLNITAASLNDDGLDNHTILLYYSTAASSLAVTLMLAIFIVYMVSRDNVSCSICL

SEQ ID NO: 27654 - protein, 584 aa, Artificial Sequence; identical to SEQ ID NO: 26426
  hemagglutinin__InfluenzaB__AGX23259

SEQ ID NO: 27655 - protein, 584 aa, Artificial Sequence; identical to SEQ ID NO: 26426
  hemagglutinin__InfluenzaB__AGX23270

SEQ ID NO: 27656 - protein, 584 aa, Artificial Sequence
  hemagglutinin__InfluenzaB__AGX23281
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNAASKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHSEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27657 - protein, 584 aa, Artificial Sequence
  hemagglutinin__InfluenzaB__AGX23292
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNANSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27658 - protein, 584 aa, Artificial Sequence
  hemagglutinin__InfluenzaB__AGX23314
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAERAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27659 - protein, 584 aa, Artificial Sequence; identical to SEQ ID NO: 27658
  hemagglutinin__InfluenzaB__AGX23325

SEQ ID NO: 27660 - protein, 584 aa, Artificial Sequence; identical to SEQ ID NO: 27658
  hemagglutinin__InfluenzaB__AGX23336

SEQ ID NO: 27661 - protein, 584 aa, Artificial Sequence; identical to SEQ ID NO: 27658
  hemagglutinin__InfluenzaB__AGX23347

SEQ ID NO: 27662 - protein, 584 aa, Artificial Sequence; identical to SEQ ID NO: 27658
  hemagglutinin__InfluenzaB__AGX23358

SEQ ID NO: 27663 - protein, 584 aa, Artificial Sequence; identical to SEQ ID NO: 27658
  hemagglutinin__InfluenzaB__AGX23369

SEQ ID NO: 27664 - protein, 584 aa, Artificial Sequence; identical to SEQ ID NO: 27658
  hemagglutinin__InfluenzaB__AGX23380

SEQ ID NO: 27665 - protein, 584 aa, Artificial Sequence; identical to SEQ ID NO: 26426
  hemagglutinin__InfluenzaB__AGX23391

SEQ ID NO: 27666 - protein, 584 aa, Artificial Sequence
  hemagglutinin__InfluenzaB__AGX23413
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSNQNVIDAERAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27667 - protein, 584 aa, Artificial Sequence; identical to SEQ ID NO: 27666
  hemagglutinin__InfluenzaB__AGX23424

SEQ ID NO: 27668 - protein, 584 aa, Artificial Sequence; identical to SEQ ID NO: 26820
  hemagglutinin__InfluenzaB__AGX23435

SEQ ID NO: 27669 - protein, 584 aa, Artificial Sequence; identical to SEQ ID NO: 26731
  hemagglutinin__InfluenzaB__AGX23446

SEQ ID NO: 27670 - protein, 584 aa, Artificial Sequence; identical to SEQ ID NO: 26820
  hemagglutinin__InfluenzaB__AGX23457

SEQ ID NO: 27671 - protein, 584 aa, Artificial Sequence; identical to SEQ ID NO: 26731
  hemagglutinin__InfluenzaB__AGX23468

SEQ ID NO: 27672 - protein, 584 aa, Artificial Sequence; identical to SEQ ID NO: 26426
  hemagglutinin__InfluenzaB__AGX23479

SEQ ID NO: 27673 - protein, 584 aa, Artificial Sequence; identical to SEQ ID NO: 26426
  hemagglutinin__InfluenzaB__AGX23490

SEQ ID NO: 27674 - protein, 584 aa, Artificial Sequence; identical to SEQ ID NO: 27047
  hemagglutinin__InfluenzaB__AGX23501

SEQ ID NO: 27675 - protein, 584 aa, Artificial Sequence
  hemagglutinin__InfluenzaB__AGX23512
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKTLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27676 - protein, 584 aa, Artificial Sequence; identical to SEQ ID NO: 26426
  hemagglutinin__InfluenzaB__AGX23523

SEQ ID NO: 27677 - protein, 584 aa, Artificial Sequence; identical to SEQ ID NO: 26731
  hemagglutinin__InfluenzaB__AGX23534

SEQ ID NO: 27678 - protein, 584 aa, Artificial Sequence; identical to SEQ ID NO: 26731
  hemagglutinin__InfluenzaB__AGX23545

SEQ ID NO: 27679 - protein, 584 aa, Artificial Sequence; identical to SEQ ID NO: 26426
  hemagglutinin__InfluenzaB__AGX23556

SEQ ID NO: 27680 - protein, 584 aa, Artificial Sequence; identical to SEQ ID NO: 26426
  hemagglutinin__InfluenzaB__AGX23567

SEQ ID NO: 27681 - protein, 584 aa, Artificial Sequence; identical to SEQ ID NO: 26426
  hemagglutinin__InfluenzaB__AGX23578

SEQ ID NO: 27682 - protein, 584 aa, Artificial Sequence; identical to SEQ ID NO: 26426
  hemagglutinin__InfluenzaB__AGX23600

SEQ ID NO: 27683 - protein, 584 aa, Artificial Sequence
  hemagglutinin__InfluenzaB__AGX23611
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEIKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27684 - protein, 584 aa, Artificial Sequence; identical to SEQ ID NO: 26426
  hemagglutinin__InfluenzaB__AGX23622

SEQ ID NO: 27685 - protein, 584 aa, Artificial Sequence; identical to SEQ ID NO: 26731
  hemagglutinin__InfluenzaB__AGX23633

SEQ ID NO: 27686 - protein, 584 aa, Artificial Sequence; identical to SEQ ID NO: 26731
  hemagglutinin__InfluenzaB__AGX23644

SEQ ID NO: 27687 - protein, 584 aa, Artificial Sequence; identical to SEQ ID NO: 26426
  hemagglutinin__InfluenzaB__AGX23655

SEQ ID NO: 27688 - protein, 584 aa, Artificial Sequence; identical to SEQ ID NO: 26731
  hemagglutinin__InfluenzaB__AGX23666

SEQ ID NO: 27689 - protein, 584 aa, Artificial Sequence
  hemagglutinin__InfluenzaB__AGX23677
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYEKIRLSTQNVIDAEKAPGGPYRLGTSGSCPNATSKSGFFATMAWAVPKDNNKNATNPLTVEVPYICIEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27690 - protein, 584 aa, Artificial Sequence; identical to SEQ ID NO: 26731
  hemagglutinin__InfluenzaB__AGX23688

SEQ ID NO: 27691 - protein, 584 aa, Artificial Sequence; identical to SEQ ID NO: 26731
  hemagglutinin__InfluenzaB__AGX23699

SEQ ID NO: 27692 - protein, 584 aa, Artificial Sequence; identical to SEQ ID NO: 26426
  hemagglutinin__InfluenzaB__AGX23710

SEQ ID NO: 27693 - protein, 584 aa, Artificial Sequence; identical to SEQ ID NO: 26731
  hemagglutinin__InfluenzaB__AGX23721

SEQ ID NO: 27694 - protein, 584 aa, Artificial Sequence; identical to SEQ ID NO: 26426
  hemagglutinin__InfluenzaB__AGX23732

SEQ ID NO: 27695 - protein, 584 aa, Artificial Sequence; identical to SEQ ID NO: 26731
  hemagglutinin__InfluenzaB__AGX23743

SEQ ID NO: 27696 - protein, 584 aa, Artificial Sequence; identical to SEQ ID NO: 26731
  hemagglutinin__InfluenzaB__AGX23754

SEQ ID NO: 27697 - protein, 584 aa, Artificial Sequence; identical to SEQ ID NO: 26426
  hemagglutinin__InfluenzaB__AGX23765

SEQ ID NO: 27698 - protein, 584 aa, Artificial Sequence; identical to SEQ ID NO: 26731
  hemagglutinin__InfluenzaB__AGX23776

SEQ ID NO: 27699 - protein, 584 aa, Artificial Sequence; identical to SEQ ID NO: 26731
  hemagglutinin__InfluenzaB__AGX23787

SEQ ID NO: 27700 - protein, 584 aa, Artificial Sequence; identical to SEQ ID NO: 26426
  hemagglutinin__InfluenzaB__AGX23798

SEQ ID NO: 27701 - protein, 584 aa, Artificial Sequence; identical to SEQ ID NO: 26426
  hemagglutinin__InfluenzaB__AGX23809

SEQ ID NO: 27702 - protein, 584 aa, Artificial Sequence; identical to SEQ ID NO: 26426
  hemagglutinin__InfluenzaB__AGX23820

SEQ ID NO: 27703 - protein, 584 aa, Artificial Sequence; identical to SEQ ID NO: 26731
  hemagglutinin__InfluenzaB__AGX23831

SEQ ID NO: 27704 - protein, 584 aa, Artificial Sequence; identical to SEQ ID NO: 26426
  hemagglutinin__InfluenzaB__AGX23842

SEQ ID NO: 27705 - protein, 584 aa, Artificial Sequence
  hemagglutinin__InfluenzaB__AGX23853
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSIQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKSGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27706 - protein, 584 aa, Artificial Sequence; identical to SEQ ID NO: 26426
  hemagglutinin__InfluenzaB__AGX23864

SEQ ID NO: 27707 - protein, 584 aa, Artificial Sequence; identical to SEQ ID NO: 26731
  hemagglutinin__InfluenzaB__AGX23875

SEQ ID NO: 27708 - protein, 584 aa, Artificial Sequence; identical to SEQ ID NO: 26426
  hemagglutinin__InfluenzaB__AGX23886

SEQ ID NO: 27709 - protein, 584 aa, Artificial Sequence
  hemagglutinin__InfluenzaB__AGX23897
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKSGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27710 - protein, 584 aa, Artificial Sequence
  hemagglutinin__InfluenzaB__AGX23908
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFVTMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27711 - protein, 584 aa, Artificial Sequence; identical to SEQ ID NO: 26567
  hemagglutinin__InfluenzaB__AGX23919

SEQ ID NO: 27712 - protein, 584 aa, Artificial Sequence; identical to SEQ ID NO: 27047
  hemagglutinin__InfluenzaB__AGX23930

SEQ ID NO: 27713 - protein, 584 aa, Artificial Sequence; identical to SEQ ID NO: 26426
  hemagglutinin__InfluenzaB__AGX23941

SEQ ID NO: 27714 - protein, 584 aa, Artificial Sequence; identical to SEQ ID NO: 26731
  hemagglutinin__InfluenzaB__AGX23952

SEQ ID NO: 27715 - protein, 584 aa, Artificial Sequence; identical to SEQ ID NO: 26731
  hemagglutinin__InfluenzaB__AGX23963

SEQ ID NO: 27716 - protein, 584 aa, Artificial Sequence; identical to SEQ ID NO: 27047
  hemagglutinin__InfluenzaB__AGX23974

SEQ ID NO: 27717 - protein, 584 aa, Artificial Sequence; identical to SEQ ID NO: 26567
  hemagglutinin__InfluenzaB__AGX23985

SEQ ID NO: 27718 - protein, 584 aa, Artificial Sequence
  hemagglutinin__InfluenzaB__AGX23996
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPITSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27719 - protein, 584 aa, Artificial Sequence; identical to SEQ ID NO: 27047
  hemagglutinin__InfluenzaB__AGX24007

SEQ ID NO: 27720 - protein, 584 aa, Artificial Sequence; identical to SEQ ID NO: 27047
  hemagglutinin__InfluenzaB__AGX24018

SEQ ID NO: 27721 - protein, 584 aa, Artificial Sequence
  hemagglutinin__InfluenzaB__AGX24029
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICKEGEDQITVWGFHSDNKTQMKNLYGDSNPQKFTSSANGVTTHYVSQIGSFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLNRIAAGTFNAGEFSLPTFDSLNITAASLNDDGLDNHTILLYYSTAASSLAVTLMLAIFIVYMVSRDNVSCSICL

SEQ ID NO: 27722 - protein, 584 aa, Artificial Sequence; identical to SEQ ID NO: 27047
  hemagglutinin__InfluenzaB__AGX24040

SEQ ID NO: 27723 - protein, 584 aa, Artificial Sequence; identical to SEQ ID NO: 26731
  hemagglutinin__InfluenzaB__AGX24051

SEQ ID NO: 27724 - protein, 584 aa, Artificial Sequence; identical to SEQ ID NO: 26820
  hemagglutinin__InfluenzaB__AGX24062

SEQ ID NO: 27725 - protein, 584 aa, Artificial Sequence; identical to SEQ ID NO: 26567
  hemagglutinin__InfluenzaB__AGX24073

SEQ ID NO: 27726 - protein, 584 aa, Artificial Sequence
  hemagglutinin__InfluenzaB__AGX24084
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASIIHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27727 - protein, 584 aa, Artificial Sequence; identical to SEQ ID NO: 27047
  hemagglutinin__InfluenzaB__AGX24095

SEQ ID NO: 27728 - protein, 584 aa, Artificial Sequence
  hemagglutinin__InfluenzaB__AGX24106
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNTTSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27729 - protein, 584 aa, Artificial Sequence
  hemagglutinin__InfluenzaB__AGX24117
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNTTSKSGFFATMAWAVPKDNNKNATNPLTVEVPYICTEGEDQITVWGFHSDNKTQMKNLYGDSNPQKFTSSANGVTTHYVSQIGSFPDQTEDGGLPQSGRIVVDYMMQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27730 - protein, 584 aa, Artificial Sequence
  hemagglutinin__InfluenzaB__AGX24128
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCIHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27731 - protein, 584 aa, Artificial Sequence; identical to SEQ ID NO: 26426
  hemagglutinin__InfluenzaB__AGX24139

SEQ ID NO: 27732 - protein, 584 aa, Artificial Sequence
  hemagglutinin__InfluenzaB__AGX24150
MKAIIVLLMVVTSNADRICTGITSSNSPHVVKTATQGEVNVTGVIPLTTTPTKSYFANLKGTRTRGKLCPYCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGSFPDQTEDGGLPQSGRIVVDYMMQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27733 - protein, 584 aa, Artificial Sequence; identical to SEQ ID NO: 27047
  hemagglutinin__InfluenzaB__AGX24161

SEQ ID NO: 27734 - protein, 584 aa, Artificial Sequence; identical to SEQ ID NO: 26820
  hemagglutinin__InfluenzaB__AGX24172

SEQ ID NO: 27735 - protein, 584 aa, Artificial Sequence; identical to SEQ ID NO: 26820
  hemagglutinin__InfluenzaB__AGX24183

SEQ ID NO: 27736 - protein, 584 aa, Artificial Sequence; identical to SEQ ID NO: 26820
  hemagglutinin__InfluenzaB__AGX24194

SEQ ID NO: 27737 - protein, 584 aa, Artificial Sequence; identical to SEQ ID NO: 26567
  hemagglutinin__InfluenzaB__AGX24205

SEQ ID NO: 27738 - protein, 584 aa, Artificial Sequence; identical to SEQ ID NO: 26731
  hemagglutinin__InfluenzaB__AGX24227

SEQ ID NO: 27739 - protein, 584 aa, Artificial Sequence; identical to SEQ ID NO: 26820
  hemagglutinin__InfluenzaB__AGX24238

SEQ ID NO: 27740 - protein, 584 aa, Artificial Sequence
  hemagglutinin__InfluenzaB__AGX24249
MKAIIVLLMVVTSNADRICTGITSSKSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27741 - protein, 584 aa, Artificial Sequence; identical to SEQ ID NO: 26567
  hemagglutinin__InfluenzaB__AGX24260

SEQ ID NO: 27742 - protein, 584 aa, Artificial Sequence; identical to SEQ ID NO: 27056
  hemagglutinin__InfluenzaB__AGX24271

SEQ ID NO: 27743 - protein, 584 aa, Artificial Sequence
  hemagglutinin__InfluenzaB__AGX24282
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTKGEDQITVWGFHSDNKTQMKNLYGDSNPQKFTSSANGVTTHYVSQIGSFPDQTEDGGLPQSGRIVVDYMMQKPGKTGTIVYQRGVLLPQRVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27744 - protein, 584 aa, Artificial Sequence; identical to SEQ ID NO: 26567
  hemagglutinin__InfluenzaB__AGX24293

SEQ ID NO: 27745 - protein, 584 aa, Artificial Sequence; identical to SEQ ID NO: 26567
  hemagglutinin__InfluenzaB__AGX24304

SEQ ID NO: 27746 - protein, 584 aa, Artificial Sequence; identical to SEQ ID NO: 27056
  hemagglutinin__InfluenzaB__AGX24315

SEQ ID NO: 27747 - protein, 584 aa, Artificial Sequence
  hemagglutinin__InfluenzaB__AGX24326
MKAIIVLLMVVTSNADRICTGITSSNSPHVVKTATQGEVNVTGVIPLTTTPTKSYFANLKGTRTRGKLCPDCLNCTDLDVALGRPTCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGSFPDQTEDGGLPQSGRIVVDYMMQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27748 - protein, 584 aa, Artificial Sequence
  hemagglutinin__InfluenzaB__AGX24337
MKAIIVLLMVVTSNADRICTGITSSNSPHVVKTATQGEVNVTGVIPLTTTPTKSYFANLKGTRTRGKLCPDCLNCTDLDVALGMPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27749 - protein, 584 aa, Artificial Sequence; identical to SEQ ID NO: 26820
  hemagglutinin__InfluenzaB__AGX24348

SEQ ID NO: 27750 - protein, 584 aa, Artificial Sequence; identical to SEQ ID NO: 26567
  hemagglutinin__InfluenzaB__AGX24359

SEQ ID NO: 27751 - protein, 584 aa, Artificial Sequence; identical to SEQ ID NO: 26820
  hemagglutinin__InfluenzaB__AGX24381

SEQ ID NO: 27752 - protein, 584 aa, Artificial Sequence
  hemagglutinin__InfluenzaB__AGX24392
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEIPYICTEGEDQITVWGFHSDNKTQMKNLYGDSNPQKFTSSANGVTTHYVSQIGSFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27753 - protein, 584 aa, Artificial Sequence; identical to SEQ ID NO: 26567
  hemagglutinin__InfluenzaB__AGX24403

SEQ ID NO: 27754 - protein, 584 aa, Artificial Sequence; identical to SEQ ID NO: 26820
  hemagglutinin__InfluenzaB__AGX24414

SEQ ID NO: 27755 - protein, 584 aa, Artificial Sequence; identical to SEQ ID NO: 26567
  hemagglutinin__InfluenzaB__AGX24425

SEQ ID NO: 27756 - protein, 584 aa, Artificial Sequence; identical to SEQ ID NO: 26567
  hemagglutinin__InfluenzaB__AGX24436

SEQ ID NO: 27757 - protein, 584 aa, Artificial Sequence; identical to SEQ ID NO: 27056
  hemagglutinin__InfluenzaB__AGX24447

SEQ ID NO: 27758 - protein, 584 aa, Artificial Sequence; identical to SEQ ID NO: 27747
  hemagglutinin__InfluenzaB__AGX24458

SEQ ID NO: 27759 - protein, 584 aa, Artificial Sequence
  hemagglutinin__InfluenzaB__AGX24469
MKAIIVLLMVVTSNADRICTGITSSNSPHVVKTATQGEVNVTGVIPLTTTPTKSYFANLKGTRTRGKLCPDCLNCTDLDVALGRPTCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGSFPDQTEDGGLPQSGRIVVDYMMQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMVAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27760 - protein, 584 aa, Artificial Sequence; identical to SEQ ID NO: 27056
  hemagglutinin__InfluenzaB__AGX24480

SEQ ID NO: 27761 - protein, 584 aa, Artificial Sequence; identical to SEQ ID NO: 27056
  hemagglutinin__InfluenzaB__AGX24491

SEQ ID NO: 27762 - protein, 584 aa, Artificial Sequence
  hemagglutinin__InfluenzaB__AGX24502
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVQKDNNKNATNPLTVEVPYICTEGEDQITVWGFHSDNKTQMKNLYGDSNPQKFTSSANGVTTHYVSQIGSFPDQTEDGGLPQSGRIVVDYMMQKPGKTGTIVYQRGVLLPQRVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27763 - protein, 584 aa, Artificial Sequence; identical to SEQ ID NO: 26731
  hemagglutinin__InfluenzaB__AGX24513

SEQ ID NO: 27764 - protein, 584 aa, Artificial Sequence; identical to SEQ ID NO: 27056
  hemagglutinin__InfluenzaB__AGX24524

SEQ ID NO: 27765 - protein, 584 aa, Artificial Sequence
  hemagglutinin__InfluenzaB__AGX24535
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISAQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27766 - protein, 584 aa, Artificial Sequence; identical to SEQ ID NO: 26567
  hemagglutinin__InfluenzaB__AGX24546

SEQ ID NO: 27767 - protein, 584 aa, Artificial Sequence
  hemagglutinin__InfluenzaB__AGX24557
MKTIIVLLMVVTSNADRICTGITSSNSPHVVKTATQGEVNVTGVIPLTTTPTKSYFANLKGTRTRGKLCPDCLNCTDLDVALGRPTCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGSFPDQTEDGGLPQSGRIVVDYMMQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27768 - protein, 584 aa, Artificial Sequence; identical to SEQ ID NO: 27056
  hemagglutinin__InfluenzaB__AGX24579

SEQ ID NO: 27769 - protein, 584 aa, Artificial Sequence; identical to SEQ ID NO: 27056
  hemagglutinin__InfluenzaB__AGX24590

SEQ ID NO: 27770 - protein, 584 aa, Artificial Sequence; identical to SEQ ID NO: 27056
  hemagglutinin__InfluenzaB__AGX24601

SEQ ID NO: 27771 - protein, 584 aa, Artificial Sequence; identical to SEQ ID NO: 27056
  hemagglutinin__InfluenzaB__AGX24612

SEQ ID NO: 27772 - protein, 584 aa, Artificial Sequence; identical to SEQ ID NO: 26567
  hemagglutinin__InfluenzaB__AGX24623

SEQ ID NO: 27773 - protein, 584 aa, Artificial Sequence; identical to SEQ ID NO: 27056
  hemagglutinin__InfluenzaB__AGX24634

SEQ ID NO: 27774 - protein, 584 aa, Artificial Sequence; identical to SEQ ID NO: 27765
  hemagglutinin__InfluenzaB__AGX24656

SEQ ID NO: 27775 - protein, 584 aa, Artificial Sequence; identical to SEQ ID NO: 26567
  hemagglutinin__InfluenzaB__AGX24667

SEQ ID NO: 27776 - protein, 584 aa, Artificial Sequence; identical to SEQ ID NO: 26820
  hemagglutinin__InfluenzaB__AGX24678

SEQ ID NO: 27777 - protein, 584 aa, Artificial Sequence; identical to SEQ ID NO: 27056
  hemagglutinin__InfluenzaB__AGX24689

SEQ ID NO: 27778 - protein, 584 aa, Artificial Sequence; identical to SEQ ID NO: 27056
  hemagglutinin__InfluenzaB__AGX24700

SEQ ID NO: 27779 - protein, 584 aa, Artificial Sequence; identical to SEQ ID NO: 27056
  hemagglutinin__InfluenzaB__AGX24711

SEQ ID NO: 27780 - protein, 584 aa, Artificial Sequence; identical to SEQ ID NO: 26567
  hemagglutinin__InfluenzaB__AGX24722

SEQ ID NO: 27781 - protein, 584 aa, Artificial Sequence; identical to SEQ ID NO: 26567
  hemagglutinin__InfluenzaB__AGX24733

SEQ ID NO: 27782 - protein, 584 aa, Artificial Sequence; identical to SEQ ID NO: 26567
  hemagglutinin__InfluenzaB__AGX24744

SEQ ID NO: 27783 - protein, 584 aa, Artificial Sequence; identical to SEQ ID NO: 26567
  hemagglutinin__InfluenzaB__AGX24755

SEQ ID NO: 27784 - protein, 584 aa, Artificial Sequence; identical to SEQ ID NO: 27056
  hemagglutinin__InfluenzaB__AGX24766

SEQ ID NO: 27785 - protein, 584 aa, Artificial Sequence; identical to SEQ ID NO: 26567
  hemagglutinin__InfluenzaB__AGX24777

SEQ ID NO: 27786 - protein, 584 aa, Artificial Sequence; identical to SEQ ID NO: 26567
  hemagglutinin__InfluenzaB__AGX24788

SEQ ID NO: 27787 - protein, 584 aa, Artificial Sequence; identical to SEQ ID NO: 26567
  hemagglutinin__InfluenzaB__AGX24799

SEQ ID NO: 27788 - protein, 584 aa, Artificial Sequence; identical to SEQ ID NO: 27056
  hemagglutinin__InfluenzaB__AGX24810

SEQ ID NO: 27789 - protein, 584 aa, Artificial Sequence; identical to SEQ ID NO: 27056
  hemagglutinin__InfluenzaB__AGX24821

SEQ ID NO: 27790 - protein, 584 aa, Artificial Sequence
  hemagglutinin__InfluenzaB__AGX24832
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGSFPDQTEDGGLPQSGRIVVDYMMQKPGKTGTIVYQRGILLPQRVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27791 - protein, 584 aa, Artificial Sequence
  hemagglutinin__InfluenzaB__AGX24843
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMVQKPGKTGTIVYQRGVLLPQRVWCTSGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27792 - protein, 584 aa, Artificial Sequence
  hemagglutinin__InfluenzaB__AGX24854
MKAIIVLLMVVTSNADRICTGITSSNSPHVVKTATQGEVNVTGVIPLTTTPTKSYFANLKGTRTRGKLCPECLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICAEGEDQITVWGFHSDNKTQMKNLYGDSNPQKFTSSANGVTTHYVSQIGDFPDQTEDGGLPQSGRIVVDYMVQRPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27793 - protein, 584 aa, Artificial Sequence
  hemagglutinin__InfluenzaB__AGX24865
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICAEGEDQITVWGFHSDNKTQMKNLYGDSNPQKFTSSANGVTTHYVSQIGDFPDQTEDGGLPQSGRIVVDYMVQRPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27794 - protein, 584 aa, Artificial Sequence
  hemagglutinin__InfluenzaB__AGX24876
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNSLTVEVPYICKEGEDQITVWGFHSDNKPQMKNLYGDSNPQKFTSSANGVTTHYVSQVGDFPDQTEDGGLPQSGRIVVDYMMQKPGRTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27795 - protein, 584 aa, Artificial Sequence
  hemagglutinin__InfluenzaB__AGX24887
MKAIIVLLMVVTSNADRICTGITSSNSPHVVKTATQGEVNVTGAIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPQTVEVPYICTEGEDQITVWGFHSDNKTQMKNLYGDSNPQKFTSSANGVTTHYVSQIGDFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTMSSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27796 - protein, 584 aa, Artificial Sequence
  hemagglutinin__InfluenzaB__AGX24898
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTGGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27797 - protein, 585 aa, Artificial Sequence; identical to SEQ ID NO: 26683
  hemagglutinin__InfluenzaB__AGX84854

SEQ ID NO: 27798 - protein, 585 aa, Artificial Sequence
  hemagglutinin__InfluenzaB__AGX84865
MKAIIVLLMVVTSNADRICTGITSSNSPHIVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27799 - protein, 585 aa, Artificial Sequence; identical to SEQ ID NO: 27798
  hemagglutinin__InfluenzaB__AGX84876

SEQ ID NO: 27800 - protein, 585 aa, Artificial Sequence; identical to SEQ ID NO: 27798
  hemagglutinin__InfluenzaB__AGX84887

SEQ ID NO: 27801 - protein, 585 aa, Artificial Sequence; identical to SEQ ID NO: 26683
  hemagglutinin__InfluenzaB__AGX84898

SEQ ID NO: 27802 - protein, 585 aa, Artificial Sequence
  hemagglutinin__InfluenzaB__AGX84920
MKAIIVLLMVVTSNADRICTGITSSNSPHVVKTATQGEVNVTGVIPLTTTPTKSHFANLKGTETRGKLCPKCPNCTDLDVALGRPKCTGKIPSAGVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27803 - protein, 585 aa, Artificial Sequence
  hemagglutinin__InfluenzaB__AGZ59821
MKAIIVLLMVVTSNADRICTGITSSNSPHVVKTATQGEVNVTGVIPLTTTPTKSHFANLKGTKTRGKLCPKCFNCTDLDVALGRPKCTGNIPSAKVSILHEVRPVTSGCFPIMHDRTKVRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27804 - protein, 585 aa, Artificial Sequence
  hemagglutinin__InfluenzaB__AGZ59832
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGKSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNEDGLDNHTILLYYSTAASSLAVTLMIAIFVVYMVSRDNVSCSICL

SEQ ID NO: 27805 - protein, 585 aa, Artificial Sequence
  hemagglutinin__InfluenzaB__AGZ59843
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFIVYMVSRDNVSCSICL

SEQ ID NO: 27806 - protein, 585 aa, Artificial Sequence; identical to SEQ ID NO: 27152
  hemagglutinin__InfluenzaB__AGZ59854

SEQ ID NO: 27807 - protein, 585 aa, Artificial Sequence; identical to SEQ ID NO: 26514
  hemagglutinin__InfluenzaB__AGZ59865

SEQ ID NO: 27808 - protein, 585 aa, Artificial Sequence
  hemagglutinin__InfluenzaB__AGZ59876
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCTSGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27809 - protein, 584 aa, Artificial Sequence; identical to SEQ ID NO: 26567
  hemagglutinin__InfluenzaB__AGZ59887

SEQ ID NO: 27810 - protein, 585 aa, Artificial Sequence; identical to SEQ ID NO: 26989
  hemagglutinin__InfluenzaB__AGZ59898

SEQ ID NO: 27811 - protein, 585 aa, Artificial Sequence; identical to SEQ ID NO: 27355
  hemagglutinin__InfluenzaB__AGZ59909

SEQ ID NO: 27812 - protein, 585 aa, Artificial Sequence; identical to SEQ ID NO: 26989
  hemagglutinin__InfluenzaB__AGZ59920

SEQ ID NO: 27813 - protein, 585 aa, Artificial Sequence; identical to SEQ ID NO: 26989
  hemagglutinin__InfluenzaB__AGZ59931

SEQ ID NO: 27814 - protein, 585 aa, Artificial Sequence; identical to SEQ ID NO: 26989
  hemagglutinin__InfluenzaB__AGZ59942

SEQ ID NO: 27815 - protein, 585 aa, Artificial Sequence; identical to SEQ ID NO: 26989
  hemagglutinin__InfluenzaB__AGZ59953

SEQ ID NO: 27816 - protein, 585 aa, Artificial Sequence
  hemagglutinin__InfluenzaB__AGZ59965
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRVVVDYMMQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27817 - protein, 585 aa, Artificial Sequence; identical to SEQ ID NO: 26989
  hemagglutinin__InfluenzaB__AGZ59976

SEQ ID NO: 27818 - protein, 585 aa, Artificial Sequence; identical to SEQ ID NO: 26989
  hemagglutinin__InfluenzaB__AGZ59987

SEQ ID NO: 27819 - protein, 585 aa, Artificial Sequence; identical to SEQ ID NO: 26989
  hemagglutinin__InfluenzaB__AGZ59999

SEQ ID NO: 27820 - protein, 585 aa, Artificial Sequence; identical to SEQ ID NO: 26608
  hemagglutinin__InfluenzaB__AGZ60010

SEQ ID NO: 27821 - protein, 585 aa, Artificial Sequence; identical to SEQ ID NO: 26608
  hemagglutinin__InfluenzaB__AGZ60021

SEQ ID NO: 27822 - protein, 585 aa, Artificial Sequence; identical to SEQ ID NO: 26608
  hemagglutinin__InfluenzaB__AGZ60033

SEQ ID NO: 27823 - protein, 584 aa, Artificial Sequence
  hemagglutinin__InfluenzaB__AGZ60044
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAENAPGGPYRLGTSGSCPNATSKSGFFATMAWAVPKDNNKNATNPLTVEVPYVCTEGEDQITVWGFHSDNKTQMKNLYGDSNPQKFTSSANGVTTHYVSQIGGFPAQTEDGGLPQSGRIVVDYMVQKPRKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27824 - protein, 584 aa, Artificial Sequence; identical to SEQ ID NO: 27026
  hemagglutinin__InfluenzaB__AGZ60055

SEQ ID NO: 27825 - protein, 584 aa, Artificial Sequence
  hemagglutinin__InfluenzaB__AGZ60066
MKAIIVLLMVVTSNADRICTGITSSNSPHVVKTATQGEVNVTGVIPLTTTPTKSHFANLKGTRTRGKLCPDCLNCTDLDVALGRPMCVGTTPSAKASILHEVRPVTSGCFPIMHDRTKIRQLPNLLRGYENIRLSTQNVIDAEKALGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27826 - protein, 584 aa, Artificial Sequence
  hemagglutinin__InfluenzaB__AGZ60077
MKAIIVLLMVVTSNADRICTGITSSNSPHVVKTATQGEVNVTGVIPLTTTPTKSYFANLKGTRTRGKLCPDCLNCTDLDVALGSPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKSGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHSEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27827 - protein, 584 aa, Artificial Sequence; identical to SEQ ID NO: 26731
  hemagglutinin__InfluenzaB__AGZ60088

SEQ ID NO: 27828 - protein, 584 aa, Artificial Sequence; identical to SEQ ID NO: 26426
  hemagglutinin__InfluenzaB__AGZ60099

SEQ ID NO: 27829 - protein, 584 aa, Artificial Sequence
  hemagglutinin__InfluenzaB__AGZ60131
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPITSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGSFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27830 - protein, 584 aa, Artificial Sequence; identical to SEQ ID NO: 26731
  hemagglutinin__InfluenzaB__AGZ60142

SEQ ID NO: 27831 - protein, 584 aa, Artificial Sequence; identical to SEQ ID NO: 26731
  hemagglutinin__InfluenzaB__AGZ60160

SEQ ID NO: 27832 - protein, 584 aa, Artificial Sequence; identical to SEQ ID NO: 26820
  hemagglutinin__InfluenzaB__AGZ60172

SEQ ID NO: 27833 - protein, 584 aa, Artificial Sequence; identical to SEQ ID NO: 26820
  hemagglutinin__InfluenzaB__AGZ60183

SEQ ID NO: 27834 - protein, 584 aa, Artificial Sequence
  hemagglutinin__InfluenzaB__AGZ60194
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKTGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27835 - protein, 584 aa, Artificial Sequence
  hemagglutinin__InfluenzaB__AGZ60206
MKAIIVLLMVVTSNADRICTGITSSNSPHVVKTATQGEVNVTGVIPLTTTPIKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27836 - protein, 584 aa, Artificial Sequence; identical to SEQ ID NO: 27765
  hemagglutinin__InfluenzaB__AGZ60217

SEQ ID NO: 27837 - protein, 584 aa, Artificial Sequence
  hemagglutinin__InfluenzaB__AGZ60268
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAIDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27838 - protein, 584 aa, Artificial Sequence; identical to SEQ ID NO: 26854
  hemagglutinin__InfluenzaB__AHE37993

SEQ ID NO: 27839 - protein, 584 aa, Artificial Sequence; identical to SEQ ID NO: 26899
  hemagglutinin__InfluenzaB__AHE37994

SEQ ID NO: 27840 - protein, 584 aa, Artificial Sequence; identical to SEQ ID NO: 26854
  hemagglutinin__InfluenzaB__AHE37995

SEQ ID NO: 27841 - protein, 584 aa, Artificial Sequence; identical to SEQ ID NO: 26854
  hemagglutinin__InfluenzaB__AHE37996

SEQ ID NO: 27842 - protein, 584 aa, Artificial Sequence; identical to SEQ ID NO: 26899
  hemagglutinin__InfluenzaB__AHE37997

SEQ ID NO: 27843 - protein, 584 aa, Artificial Sequence; identical to SEQ ID NO: 26899
  hemagglutinin__InfluenzaB__AHE37998

SEQ ID NO: 27844 - protein, 584 aa, Artificial Sequence; identical to SEQ ID NO: 26899
  hemagglutinin__InfluenzaB__AHE37999

SEQ ID NO: 27845 - protein, 584 aa, Artificial Sequence; identical to SEQ ID NO: 26854
  hemagglutinin__InfluenzaB__AHE38000

SEQ ID NO: 27846 - protein, 584 aa, Artificial Sequence; identical to SEQ ID NO: 26854
  hemagglutinin__InfluenzaB__AHE38001

SEQ ID NO: 27847 - protein, 584 aa, Artificial Sequence
  hemagglutinin__InfluenzaB__AHE38002
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAKKAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27848 - protein, 584 aa, Artificial Sequence; identical to SEQ ID NO: 26854
  hemagglutinin__InfluenzaB__AHE38003

SEQ ID NO: 27849 - protein, 584 aa, Artificial Sequence; identical to SEQ ID NO: 26854
  hemagglutinin__InfluenzaB__AHE38004

SEQ ID NO: 27850 - protein, 584 aa, Artificial Sequence; identical to SEQ ID NO: 26854
  hemagglutinin__InfluenzaB__AHE38005

SEQ ID NO: 27851 - protein, 584 aa, Artificial Sequence
  hemagglutinin__InfluenzaB__AHE38006
MKAIIVLLMVVTSNADRICTGITSSNSPHVVKTATQGEVNVTGVIPLTTTPTKSYFANLKGTKTRGKLCPDCLNCTDLDVALGRPMCVGATPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAVDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27852 - protein, 584 aa, Artificial Sequence; identical to SEQ ID NO: 26854
  hemagglutinin__InfluenzaB__AHE38007

SEQ ID NO: 27853 - protein, 584 aa, Artificial Sequence
  hemagglutinin__InfluenzaB__AHE38008
MKAIIALLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQIAVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27854 - protein, 584 aa, Artificial Sequence; identical to SEQ ID NO: 26899
  hemagglutinin__InfluenzaB__AHE38009

SEQ ID NO: 27855 - protein, 584 aa, Artificial Sequence; identical to SEQ ID NO: 26899
  hemagglutinin__InfluenzaB__AHE38010

SEQ ID NO: 27856 - protein, 584 aa, Artificial Sequence; identical to SEQ ID NO: 26854
  hemagglutinin__InfluenzaB__AHE38012

SEQ ID NO: 27857 - protein, 584 aa, Artificial Sequence
  hemagglutinin__InfluenzaB__AHE38013
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCVSGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGMAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27858 - protein, 584 aa, Artificial Sequence; identical to SEQ ID NO: 26854
  hemagglutinin__InfluenzaB__AHE38014

SEQ ID NO: 27859 - protein, 585 aa, Artificial Sequence; identical to SEQ ID NO: 26645
  hemagglutinin__InfluenzaB__AHE38015

SEQ ID NO: 27860 - protein, 585 aa, Artificial Sequence
  hemagglutinin__InfluenzaB__AHE38016
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGKSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHIILLYYSTAASSLAVTLMIAIFVVYMVSRDNVSCSICL

SEQ ID NO: 27861 - protein, 585 aa, Artificial Sequence; identical to SEQ ID NO: 26964
  hemagglutinin__InfluenzaB__AHE38017

SEQ ID NO: 27862 - protein, 585 aa, Artificial Sequence; identical to SEQ ID NO: 26887
  hemagglutinin__InfluenzaB__AHE38018

SEQ ID NO: 27863 - protein, 585 aa, Artificial Sequence; identical to SEQ ID NO: 26872
  hemagglutinin__InfluenzaB__AHE38019

SEQ ID NO: 27864 - protein, 585 aa, Artificial Sequence
  hemagglutinin__InfluenzaB__AHE38020
MKAIIVLLMVVTSNADRICTGITSSNSPHVVKTATQGEVNVTGVIPLTITPTKSHFANLKGTETRGKLCPKCLNCTDLDVALGRPKCTGKIPSARVSILHEVRPVTSGCFPIMHDRTKIRQLPNLLRGYEHIRLSTHNVINAEDAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27865 - protein, 585 aa, Artificial Sequence
  hemagglutinin__InfluenzaB__AHE38021
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSNPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27866 - protein, 585 aa, Artificial Sequence; identical to SEQ ID NO: 26887
  hemagglutinin__InfluenzaB__AHE38022

SEQ ID NO: 27867 - protein, 583 aa, Artificial Sequence
  hemagglutinin__InfluenzaB__AHL91189
MKAIIVLLMVATSNADRICTGITSSNSPHVVKTATQGEVNVTGVISLTTTPTKSHFANLKGTKTRGKLCPNCLNCTDLDVALGRPICIGTIPSAKASILHEVRPVTSGCFPIMHDRTKIRQLPNLLRGYEHIRLSTHNVINAERAPGGPYRLGTSGSCPNVTSRSGFFATMAWAVPRDNKTATNPLTVEVPYICTKGEDQITVWGFHSDNKTQMKNLYGDSNPQKFTSSANGVTTHYVSQIGGFPNQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 27868 - protein, 583 aa, Artificial Sequence
  hemagglutinin__InfluenzaB__AHL91200
MKAIIVLLMVVTSNADRICTGITSSNSPHVVKTATQGEVNVTGVIPLTTTPTKSHFANLKGTKTRGKLCPNCLNCTDLDVALGRPMCIGTIPSAKASILHEVRPVTSGCFPIMHDRTKIRQLPNLLRGYEHIRLSTHNVINAERAPGGPYRLGTSGSCPNVTSRSGFFATMAWAVPRDNKTATNPLTVEVPYICTKGEDQITVWGFHSDNKTQMKNLYGDSNPQKFTSSANGVTTHYVSQIGDFPNQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 27869 - protein, 583 aa, Artificial Sequence
  hemagglutinin__InfluenzaB__AHL91211
MKAIIVLLMVATSNADRICTGITSSNSPHVVKTATQGEVNVTGVISLTTTPTKSHFANLKGTKTRGKLCPNCLNCTDLDVALGRPMCIGTIPSAKASILHEVRPVTSGCFPIMHDRTKIRQLPNLLRGYEHIRLSTHNVINAERAPGGPYRLGTSGSCPNVTSRSGFFATMAWAVPRDNKTATNPLTVEVPYICTKGEDQITVWGFHSDNKTQMKNLYGDSNPQKFTSSANGVTTHYVSQIGGFPNQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 27870 - protein, 584 aa, Artificial Sequence
  hemagglutinin__InfluenzaB__AHL91222
MKAIIVLLMVVTSNADRICTGITSSNSPHVVKTATQGEVNVTGVIPLTTTPTKSHFANLKGTKTRGKLCPNCLNCTDLDVALGRPMCVGTTPSAKASILHEVRPVTSGCFPIMHDRTKIRQLPNLLRGYENIRLSTQNVINAEKAPGGPYRLGTSGSCPNATSRSGFFATMAWAVPRDNNKTATNPLTVEVPYVCTEGEDQITVWGFHSDNKTQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNISCSICL

SEQ ID NO: 27871 - protein, 584 aa, Artificial Sequence
  hemagglutinin__InfluenzaB__AHL91244
MKAIIVLLMVVTSNADRICTGITSSNSPHVVKTATQGEVNVTGVIPLTTTPTKSHFANLKGTKTRGKLCPTCLNCTDLDVALGRPMCVGTTPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTVEVPYICTKEEDQITVWGFHSDNKTQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 27872 - protein, 584 aa, Artificial Sequence; identical to SEQ ID NO: 26501
  hemagglutinin__InfluenzaB__AHL91255

SEQ ID NO: 27873 - protein, 584 aa, Artificial Sequence; identical to SEQ ID NO: 26501
  hemagglutinin__InfluenzaB__AHL91266

SEQ ID NO: 27874 - protein, 583 aa, Artificial Sequence
  hemagglutinin__InfluenzaB__AHL91277
MKAIIVLLMVVTSNADRICTGITSSNSPHVVKTATQGEVNVTGVIPLTTTPTKSHFANLKGTKTRGKLCPNCLNCTDLDVALGRPMCIGITPSAKASILHEVRPVTSGCFPIMHDRTKIRQLPNLLRGYEHIRLSTHNVINAERAPGGPYRLGTSGSCPNVTSRSGFFATMAWAVPRDNKTATNPLTVEVPYICTKGEDQITVWGFHSDNKTQMKNLYGDSNPQKFTSSANGITTHYVSQIGGFPNQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 27875 - protein, 584 aa, Artificial Sequence
  hemagglutinin__InfluenzaB__AHL91299
MKAIIVLLMVVTSNADRICTGITSSNSPHVVKTATQGEVNVTGVIPLTTTPTRSHFANLKGTKTRGKLCPTCLNCTDLDVALGRPMCVGTTPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTVEVPYICTKEEDQITVWGFHSDNKTQMKNLYGDSNPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 27876 - protein, 584 aa, Artificial Sequence
  hemagglutinin__InfluenzaB__AHL91310
MKAIIVLLMVVTSNADRICTGITSSNSPHVVKTATQGEVNVTGVIPLTTTPTKSHFANLKGTKTRGKLCPTCLNCTDLDVALGRPMCVGTTPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTVEVPYICTKEEDQITVWGFHSDNKTQMKNLYGDSNPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 27877 - protein, 584 aa, Artificial Sequence
  hemagglutinin__InfluenzaB__AHL91321
MKAIIVLLMVVTSNADRICTGITSSNSPHVVKTATQGEVNVTGVIPLTTTPTKSHFANLKGTKTRGKLCPTCLNCTDLDVALGRPMCVGTTPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTVEVPYICTKEEDQITVWGFHSDNKTQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKEKGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 27878 - protein, 584 aa, Artificial Sequence; identical to SEQ ID NO: 27876
  hemagglutinin__InfluenzaB__AHL91332

SEQ ID NO: 27879 - protein, 584 aa, Artificial Sequence; identical to SEQ ID NO: 27876
  hemagglutinin__InfluenzaB__AHL91343

SEQ ID NO: 27880 - protein, 584 aa, Artificial Sequence; identical to SEQ ID NO: 27876
  hemagglutinin__InfluenzaB__AHL91354

SEQ ID NO: 27881 - protein, 584 aa, Artificial Sequence; identical to SEQ ID NO: 26479
  hemagglutinin__InfluenzaB__AHL91365

SEQ ID NO: 27882 - protein, 584 aa, Artificial Sequence
  hemagglutinin__InfluenzaB__AHL91376
MKAIIVLLMVVTSNADRICTGITSSNSPHVVKTATQGEVNVTGVIPLTATPTKSHFANLKGTKTRGKLCPTCLNCTDLDVALGRPMCVGVTPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTVEVPHICTKEEDQITVWGFHSDNKTQMKNLYGDSNPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 27883 - protein, 584 aa, Artificial Sequence
  hemagglutinin__InfluenzaB__AHL91387
MKAIIVLLMVVTSNADRICTGITSSNSPHVVKTATQGEVNVTGVIPLTTTPAKSHFANLKGTKTRGKLCPTCLNCTDLDVALGRPMCVGVTPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTVEVPHICTKEEDQITVWGFHSDNKTQMKNLYGDSNPQKFTSSANGVTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 27884 - protein, 584 aa, Artificial Sequence
  hemagglutinin__InfluenzaB__AHL91409
MKAIIVLLMVVTSNADRICTGITSSDSPHVVKTATQGEVNVTGAIPLTTTPTKSYFANLKGTKTRGKLCPTCLNCTDLDVALGRPMCVGITPSAKASILHEVRPVTSGCFPIMHDRTKIRQLPNLLRGYEKIRLSTQNVINAEKAPGGPYRLGTSGSCPNATSRSGFFATMAWAVPRDNNKTATNPLTVEVPHICTKEEDQITVWGFHSDNKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMVAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 27885 - protein, 584 aa, Artificial Sequence
  hemagglutinin__InfluenzaB__AHL91431
MKAIIVLLMVVTSNADRICTGITSSNSPHVVKTATQGEVNVTGAIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAEKAPGGPYRLGTSGSCPNATSKSGFFATMAWAVPRDNNKTATNPLTVEVPHICTKEEDQITVWGFHSDNKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNFLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 27886 - protein, 584 aa, Artificial Sequence
  hemagglutinin__InfluenzaB__AHL91442
MKAIIVLLMVVTSNADRICTGITSSNSPHVVKTATQGEVNVTGAIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAETAPGGPYRLGTSGSCPNATSKSGFFATMAWAVPRDNNKTATNPLTVEVPHICTKEEDQITVWGFHSDNKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 27887 - protein, 584 aa, Artificial Sequence
  hemagglutinin__InfluenzaB__AHL91453
MKAIIVLLMVVTSNADRICTGITSSNSPHVVKTATQGEVNVTGAIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAEKAPGGPYRLGTSGSCPNATSKSGFFATMAWAVPRDNNKTATNPLTIEVPHVCTKEEDQITVWGFHSDNKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 27888 - protein, 584 aa, Artificial Sequence; identical to SEQ ID NO: 26405
  hemagglutinin__InfluenzaB__AHL91464

SEQ ID NO: 27889 - protein, 584 aa, Artificial Sequence; identical to SEQ ID NO: 26511
  hemagglutinin__InfluenzaB__AHL91475

SEQ ID NO: 27890 - protein, 584 aa, Artificial Sequence; identical to SEQ ID NO: 27886
  hemagglutinin__InfluenzaB__AHL91486

SEQ ID NO: 27891 - protein, 584 aa, Artificial Sequence; identical to SEQ ID NO: 27886
  hemagglutinin__InfluenzaB__AHL91497

SEQ ID NO: 27892 - protein, 584 aa, Artificial Sequence; identical to SEQ ID NO: 27886
  hemagglutinin__InfluenzaB__AHL91530

SEQ ID NO: 27893 - protein, 584 aa, Artificial Sequence; identical to SEQ ID NO: 26405
  hemagglutinin__InfluenzaB__AHL91541

SEQ ID NO: 27894 - protein, 584 aa, Artificial Sequence; identical to SEQ ID NO: 27886
  hemagglutinin__InfluenzaB__AHL91552

SEQ ID NO: 27895 - protein, 584 aa, Artificial Sequence; identical to SEQ ID NO: 27886
  hemagglutinin__InfluenzaB__AHL91574

SEQ ID NO: 27896 - protein, 584 aa, Artificial Sequence
  hemagglutinin__InfluenzaB__AHL91585
MKAIIVLLMVVTSNADRICTGITSSNSPHVVKTATQGEVNVTGAIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAEKAPGGPYRLGTSGSCPNATSKSGFFATMAWAVPRDNNKTATNPLTVEVPHICTKEEDQITVWGFHSDNKTQMKNLYGDSNPQKFTSSANGMTTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 27897 - protein, 584 aa, Artificial Sequence
  hemagglutinin__InfluenzaB__AHL91596
MKAIIVLLMVVTSNADRICTGITSSNSPHVVKTATQGEVNVTGAIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAEKAPGGPYRLGTSGSCPNATSKSGFFATMAWAVPRDNNKTATNPLTVEVPHICTKEEDQITVWGFHSDNKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKILKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 27898 - protein, 584 aa, Artificial Sequence; identical to SEQ ID NO: 27897
  hemagglutinin__InfluenzaB__AHL91607

SEQ ID NO: 27899 - protein, 584 aa, Artificial Sequence
  hemagglutinin__InfluenzaB__AHL91618
MKAIIVLLMVVTSNADRICTGITSSNSPHVVKTATQGEVNVTGAIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAETAPGGPYRLGTSGSCPNATSKSGFFATMAWAVPRDNNKTATNPLTVEVPHICTKEEDQITVWGFHSDNKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNVGEFSLPTFDSLNITAASLNDDGLDNHTILLYYSTAASSLAVTLMIAIFIVYMISRDNVSCSICL

SEQ ID NO: 27900 - protein, 584 aa, Artificial Sequence
  hemagglutinin__InfluenzaB__AHL91629
MKAIIVLLMVVTSNADRICTGITSSNSPHVVKTATQGEVNVTGAIPLTTTPTKSHFANLKGTKTRGKLCPTCFNCTDLDVALGRPMCVGITPSAKASILHEVRPVTSGCFPIMHDRTKIRQLPNLLRGYEKIRLSTQNVIDAEKAPGGPYKLGTSGSCPNATSKSGFFATMAWAVPRDNNKTATNPLTVEVPHICTKEEDQITVWGFHSDNKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 27901 - protein, 584 aa, Artificial Sequence; identical to SEQ ID NO: 27900
  hemagglutinin__InfluenzaB__AHL91640

SEQ ID NO: 27902 - protein, 584 aa, Artificial Sequence; identical to SEQ ID NO: 26407
  hemagglutinin__InfluenzaB__AHL91651

SEQ ID NO: 27903 - protein, 583 aa, Artificial Sequence
  hemagglutinin__InfluenzaB__AHL91662
MKAIIVLLMVVTSNADRICTGITSSNSPHVVKTATQGEVNVTGAIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAETAPGGPYRLGTSGSCPNATSKSGFFATMAWAVPRDNNKTATNPLTVEVPHICTKEEDQITVWGFHSDNKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDGLDNHTILLYYSTAASSLAVTLMIAIFIVYMISRDNVSCSICL

SEQ ID NO: 27904 - protein, 584 aa, Artificial Sequence; identical to SEQ ID NO: 26511
  hemagglutinin__InfluenzaB__AHL91673

SEQ ID NO: 27905 - protein, 584 aa, Artificial Sequence
  hemagglutinin__InfluenzaB__AHL91684
MKAIIVLLMVVTSNADRICTGITSSNSPHVVKTATQGEVNVTGAIPLTTTPTKSHFANLKGTKTRGKLCPTCLNCTDLDVALGRPMCVGITPSAKASILHEVRPVTSGCFPIMHDRTKIRQLPNLLRGYEKIRLSTQNVINAEKAPGGPYRLGTSGSCPNATSKSGFFATMAWAVPRDNNKTATNPLTIEVPHICTKEEDQITVWGFHSDNKTQMKNLYGDSNPQKFTSSANGITTHYVSQIGGFPDQTEDGGLPQSGRIVVDYMVQKPGKTGTIVYQRGILLPQKVWCASGRSKVIKGFLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMISRDNVSCSICL

SEQ ID NO: 27906 - protein, 584 aa, Artificial Sequence; identical to SEQ ID NO: 26407
  hemagglutinin__InfluenzaB__AHL91695

SEQ ID NO: 27907 - protein, 584 aa, Artificial Sequence; identical to SEQ ID NO: 26511
  hemagglutinin__InfluenzaB__AHL91706

SEQ ID NO: 27908 - protein, 585 aa, Artificial Sequence; identical to SEQ ID NO: 26979
  hemagglutinin__InfluenzaB__AHL91717

SEQ ID NO: 27909 - protein, 585 aa, Artificial Sequence; identical to SEQ ID NO: 26979
  hemagglutinin__InfluenzaB__AHL91728

SEQ ID NO: 27910 - protein, 585 aa, Artificial Sequence; identical to SEQ ID NO: 26979
  hemagglutinin__InfluenzaB__AHL91739

SEQ ID NO: 27911 - protein, 584 aa, Artificial Sequence; identical to SEQ ID NO: 26511
  hemagglutinin__InfluenzaB__AHL91750

SEQ ID NO: 27912 - protein, 585 aa, Artificial Sequence; identical to SEQ ID NO: 26979
  hemagglutinin__InfluenzaB__AHL91761

SEQ ID NO: 27913 - protein, 585 aa, Artificial Sequence
  hemagglutinin__InfluenzaB__AHL91772
MKAIIVLLMVVTSNADRICTGITSSNSPHVVKTATQGEVNVTGVIPLTTTPTKSHFANLKGTKTRGKLCPKCLNCTDLDVALGRPKCTGNIPSAKVSILHEVRPVTSGCFPIMHDRTKIRQLPNLLRGYEHIRLSTHNVINAEKAPGGPYKIGTSGSCPNITNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27914 - protein, 585 aa, Artificial Sequence; identical to SEQ ID NO: 27913
  hemagglutinin__InfluenzaB__AHL91783

SEQ ID NO: 27915 - protein, 585 aa, Artificial Sequence; identical to SEQ ID NO: 27913
  hemagglutinin__InfluenzaB__AHL91794

SEQ ID NO: 27916 - protein, 585 aa, Artificial Sequence
  hemagglutinin__InfluenzaB__AHL91805
MKAIIVLLMVVTSNADRICTGITSSNSPHVVKTATQGEVNVTGVIPLTTTPTKSHFANLKGTKTRGKLCPKCFNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27917 - protein, 585 aa, Artificial Sequence; identical to SEQ ID NO: 26419
  hemagglutinin__InfluenzaB__AHL91816

SEQ ID NO: 27918 - protein, 585 aa, Artificial Sequence; identical to SEQ ID NO: 26419
  hemagglutinin__InfluenzaB__AHL91827

SEQ ID NO: 27919 - protein, 584 aa, Artificial Sequence; identical to SEQ ID NO: 27026
  hemagglutinin__InfluenzaB__AHL91838

SEQ ID NO: 27920 - protein, 584 aa, Artificial Sequence
  hemagglutinin__InfluenzaB__AHL91849
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEARPVTSGCFPIMHDRTKIRQLPNLLRGYENIRLSTQNVIDAENAPGGPYRLGTSGSCPNATSKSGFFATMAWAVPKDNNKNATNPLTVEVPYICKEGEDQITVWGFHSDNKTQMKNLYGDSNPQKFTSSANGVTTHYVSQISGFPAQTEDGGLPQSGRIVVDYMVQKPRKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27921 - protein, 584 aa, Artificial Sequence
  hemagglutinin__InfluenzaB__AHL91860
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEIPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHAILLYYSTAASSLAVTLMLAIFIVYMVSRDNVSCSICL

SEQ ID NO: 27922 - protein, 584 aa, Artificial Sequence
  hemagglutinin__InfluenzaB__AHL91871
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEIPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27923 - protein, 584 aa, Artificial Sequence; identical to SEQ ID NO: 26426
  hemagglutinin__InfluenzaB__AHL91882

SEQ ID NO: 27924 - protein, 584 aa, Artificial Sequence
  hemagglutinin__InfluenzaB__AHL91904
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKHGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27925 - protein, 584 aa, Artificial Sequence
  hemagglutinin__InfluenzaB__AHL91915
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNYKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27926 - protein, 584 aa, Artificial Sequence; identical to SEQ ID NO: 27024
  hemagglutinin__InfluenzaB__AHL91926

SEQ ID NO: 27927 - protein, 584 aa, Artificial Sequence; identical to SEQ ID NO: 27599
  hemagglutinin__InfluenzaB__AHL91937

SEQ ID NO: 27928 - protein, 584 aa, Artificial Sequence; identical to SEQ ID NO: 26426
  hemagglutinin__InfluenzaB__AHL91948

SEQ ID NO: 27929 - protein, 585 aa, Artificial Sequence
  hemagglutinin__InfluenzaB__AHL91959
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASFNDDGLDNHTILLYYSTAASSLAVTLMIAIFVVYMVSRDNVSCSICL

SEQ ID NO: 27930 - protein, 585 aa, Artificial Sequence; identical to SEQ ID NO: 26638
  hemagglutinin__InfluenzaB__AHL91970

SEQ ID NO: 27931 - protein, 584 aa, Artificial Sequence
  hemagglutinin__InfluenzaB__AHL91991
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATNKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27932 - protein, 585 aa, Artificial Sequence; identical to SEQ ID NO: 26514
  hemagglutinin__InfluenzaB__AHL92002

SEQ ID NO: 27933 - protein, 585 aa, Artificial Sequence; identical to SEQ ID NO: 26514
  hemagglutinin__InfluenzaB__AHL92013

SEQ ID NO: 27934 - protein, 585 aa, Artificial Sequence; identical to SEQ ID NO: 26514
  hemagglutinin__InfluenzaB__AHL92024

SEQ ID NO: 27935 - protein, 585 aa, Artificial Sequence; identical to SEQ ID NO: 26514
  hemagglutinin__InfluenzaB__AHL92035

SEQ ID NO: 27936 - protein, 585 aa, Artificial Sequence; identical to SEQ ID NO: 26514
  hemagglutinin__InfluenzaB__AHL92046

SEQ ID NO: 27937 - protein, 585 aa, Artificial Sequence; identical to SEQ ID NO: 26514
  hemagglutinin__InfluenzaB__AHL92057

SEQ ID NO: 27938 - protein, 585 aa, Artificial Sequence
  hemagglutinin__InfluenzaB__AHL92068
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNITNGNGFFATMAWAVPKNDNNKTATNSLTIEVPYICTEGEDQITVWGFHSDNETQMAKLYGDSKPQKFTSSANGVTTHYVSQVGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27939 - protein, 585 aa, Artificial Sequence
  hemagglutinin__InfluenzaB__AHL92079
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNITNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 27940 - protein, 585 aa, Artificial Sequence; identical to SEQ ID NO: 27939
  hemagglutinin__InfluenzaB__AHL92090

SEQ ID NO: 27941 - protein, 585 aa, Artificial Sequence; identical to SEQ ID NO: 26514
  hemagglutinin__InfluenzaB__AHL92101

SEQ ID NO: 27942 - protein, 584 aa, Artificial Sequence; identical to SEQ ID NO: 26567
  hemagglutinin__InfluenzaB__AHL92112

SEQ ID NO: 27943 - protein, 585 aa, Artificial Sequence; identical to SEQ ID NO: 26514
  hemagglutinin__InfluenzaB__AHL92123

SEQ ID NO: 27944 - protein, 585 aa, Artificial Sequence; identical to SEQ ID NO: 27939
  hemagglutinin__InfluenzaB__AHL92134

SEQ ID NO: 27945 - protein, 585 aa, Artificial Sequence; identical to SEQ ID NO: 27939
  hemagglutinin__InfluenzaB__AHL92145

SEQ ID NO: 27946 - protein, 585 aa, Artificial Sequence; identical to SEQ ID NO: 26514
  hemagglutinin__InfluenzaB__AHL92156

SEQ ID NO: 27947 - protein, 585 aa, Artificial Sequence; identical to SEQ ID NO: 27939
  hemagglutinin__InfluenzaB__AHL92167

SEQ ID NO: 27948 - protein, 585 aa, Artificial Sequence; identical to SEQ ID NO: 26514
  hemagglutinin__InfluenzaB__AHL92178

SEQ ID NO: 27949 - protein, 585 aa, Artificial Sequence; identical to SEQ ID NO: 26514
  hemagglutinin__InfluenzaB__AHL92189

SEQ ID NO: 27950 - protein, 584 aa, Artificial Sequence; identical to SEQ ID NO: 26567
  hemagglutinin__InfluenzaB__AHL92200

SEQ ID NO: 27951 - protein, 585 aa, Artificial Sequence; identical to SEQ ID NO: 26514
  hemagglutinin__InfluenzaB__AHL92211

SEQ ID NO: 27952 - protein, 585 aa, Artificial Sequence; identical to SEQ ID NO: 26514
  hemagglutinin__InfluenzaB__AHL92222

SEQ ID NO: 27953 - protein, 584 aa, Artificial Sequence; identical to SEQ ID NO: 27829
  hemagglutinin__InfluenzaB__AHL92233

SEQ ID NO: 27954 - protein, 585 aa, Artificial Sequence; identical to SEQ ID NO: 27939
  hemagglutinin__InfluenzaB__AHL92244

SEQ ID NO: 27955 - protein, 585 aa, Artificial Sequence; identical to SEQ ID NO: 26514
  hemagglutinin__InfluenzaB__AHL92255

SEQ ID NO: 27956 - protein, 585 aa, Artificial Sequence; identical to SEQ ID NO: 26514
  hemagglutinin__InfluenzaB__AHL92266

SEQ ID NO: 27957 - protein, 585 aa, Artificial Sequence
  hemagglutinin__InfluenzaB__AHL92277
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIATGTFDAGEFSLPTFDSLNITAASLNDDGLDNHTILLYYSTAASSLAVTLMIAIFVVYMVSRDNVSCSICL

SEQ ID NO: 27958 - protein, 585 aa, Artificial Sequence; identical to SEQ ID NO: 26514
  hemagglutinin__InfluenzaB__AHL92288

SEQ ID NO: 27959 - protein, 585 aa, Artificial Sequence; identical to SEQ ID NO: 26514
  hemagglutinin__InfluenzaB__AHL92299

SEQ ID NO: 27960 - protein, 584 aa, Artificial Sequence; identical to SEQ ID NO: 27632
  hemagglutinin__InfluenzaB__AHL92310

SEQ ID NO: 27961 - protein, 584 aa, Artificial Sequence; identical to SEQ ID NO: 26567
  hemagglutinin__InfluenzaB__AHL92321

SEQ ID NO: 27962 - protein, 584 aa, Artificial Sequence; identical to SEQ ID NO: 26567
  hemagglutinin__InfluenzaB__AHL92332

SEQ ID NO: 27963 - protein, 584 aa, Artificial Sequence
  hemagglutinin__InfluenzaB__AHL92354
MKAIIVLLMVVTSNADRICTGITSSNSPHVVKTATQGEVNVTGVIPLTTTPTKSYFANLKGTRTRGKLCPDCLNCTDLDVALGRPMCVGITPSAKASILHEVRPVTSGCFPIMHDRTKIRQLANLLRGYENIRLSTQNVVDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27964 - protein, 584 aa, Artificial Sequence; identical to SEQ ID NO: 27963
  hemagglutinin__InfluenzaB__AHL92365

SEQ ID NO: 27965 - protein, 584 aa, Artificial Sequence; identical to SEQ ID NO: 26820
  hemagglutinin__InfluenzaB__AHL92376

SEQ ID NO: 27966 - protein, 584 aa, Artificial Sequence; identical to SEQ ID NO: 26820
  hemagglutinin__InfluenzaB__AHL92387

SEQ ID NO: 27967 - protein, 584 aa, Artificial Sequence; identical to SEQ ID NO: 26820
  hemagglutinin__InfluenzaB__AHL92398

SEQ ID NO: 27968 - protein, 584 aa, Artificial Sequence; identical to SEQ ID NO: 26820
  hemagglutinin__InfluenzaB__AHL92409

SEQ ID NO: 27969 - protein, 584 aa, Artificial Sequence; identical to SEQ ID NO: 26820
  hemagglutinin__InfluenzaB__AHL92420

SEQ ID NO: 27970 - protein, 584 aa, Artificial Sequence; identical to SEQ ID NO: 26567
  hemagglutinin__InfluenzaB__AHL92431

SEQ ID NO: 27971 - protein, 584 aa, Artificial Sequence; identical to SEQ ID NO: 26820
  hemagglutinin__InfluenzaB__AHL92442

SEQ ID NO: 27972 - protein, 584 aa, Artificial Sequence; identical to SEQ ID NO: 26820
  hemagglutinin__InfluenzaB__AHL92453

SEQ ID NO: 27973 - protein, 584 aa, Artificial Sequence; identical to SEQ ID NO: 26820
  hemagglutinin__InfluenzaB__AHL92464

SEQ ID NO: 27974 - protein, 584 aa, Artificial Sequence
  hemagglutinin__InfluenzaB__AHL92475
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQACLDRIAAGTFNAGEFSLPTFDSLNITAASLNDDGLDNHTILLYYSTAASSLAVTLMLAIFIVYMVSRDNVSCSICL

SEQ ID NO: 27975 - protein, 584 aa, Artificial Sequence; identical to SEQ ID NO: 26567
  hemagglutinin__InfluenzaB__AHL92486

SEQ ID NO: 27976 - protein, 584 aa, Artificial Sequence; identical to SEQ ID NO: 26820
  hemagglutinin__InfluenzaB__AHL92497

SEQ ID NO: 27977 - protein, 584 aa, Artificial Sequence; identical to SEQ ID NO: 26820
  hemagglutinin__InfluenzaB__AHL92508

SEQ ID NO: 27978 - protein, 584 aa, Artificial Sequence; identical to SEQ ID NO: 26820
  hemagglutinin__InfluenzaB__AHL92519

SEQ ID NO: 27979 - protein, 584 aa, Artificial Sequence; identical to SEQ ID NO: 26820
  hemagglutinin__InfluenzaB__AHL92530

SEQ ID NO: 27980 - protein, 584 aa, Artificial Sequence; identical to SEQ ID NO: 26567
  hemagglutinin__InfluenzaB__AHL92541

SEQ ID NO: 27981 - protein, 583 aa, Artificial Sequence
  hemagglutinin__InfluenzaB__AHL92563
MKAIIVLLMVVTSNADRICTGITSSNSPHVVKTATQGEVNVTGVIPLTTTPKKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDGLDNHTILLYYSTAASSLAVTLMLAIFIVYMVSRDNVSCSICL

SEQ ID NO: 27982 - protein, 584 aa, Artificial Sequence; identical to SEQ ID NO: 26820
  hemagglutinin__InfluenzaB__AHL92574

SEQ ID NO: 27983 - protein, 584 aa, Artificial Sequence
  hemagglutinin__InfluenzaB__AHL92585
MKAIIVLLMVVTSNADRICTGITSSNSPHVVKTATQGEVNVTGVIPLTTTPTKSYFANLKGTRTRGKLCPDCLNCTDLDVALGRPMCVGATPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGSFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27984 - protein, 584 aa, Artificial Sequence; identical to SEQ ID NO: 26820
  hemagglutinin__InfluenzaB__AHL92596

SEQ ID NO: 27985 - protein, 584 aa, Artificial Sequence; identical to SEQ ID NO: 26567
  hemagglutinin__InfluenzaB__AHL92607

SEQ ID NO: 27986 - protein, 584 aa, Artificial Sequence
  hemagglutinin__InfluenzaB__AHL92629
MKAIIVLLMVVTSNADRICTGITSSNSPHVVKTATQGEVNVTGVIPLTTTPEKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27987 - protein, 584 aa, Artificial Sequence; identical to SEQ ID NO: 26567
  hemagglutinin__InfluenzaB__AHL92640

SEQ ID NO: 27988 - protein, 584 aa, Artificial Sequence; identical to SEQ ID NO: 26567
  hemagglutinin__InfluenzaB__AHL92651

SEQ ID NO: 27989 - protein, 584 aa, Artificial Sequence
  hemagglutinin__InfluenzaB__AHL92684
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGSFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHIILLYYSTAASSLAVTLMLAIFIVYMVSRDNVSCSICL

SEQ ID NO: 27990 - protein, 584 aa, Artificial Sequence; identical to SEQ ID NO: 26820
  hemagglutinin__InfluenzaB__AHL92695

SEQ ID NO: 27991 - protein, 584 aa, Artificial Sequence; identical to SEQ ID NO: 26820
  hemagglutinin__InfluenzaB__AHL92706

SEQ ID NO: 27992 - protein, 584 aa, Artificial Sequence
  hemagglutinin__InfluenzaB__AHL92728
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEIIELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27993 - protein, 584 aa, Artificial Sequence; identical to SEQ ID NO: 27992
  hemagglutinin__InfluenzaB__AHL92739

SEQ ID NO: 27994 - protein, 584 aa, Artificial Sequence; identical to SEQ ID NO: 27992
  hemagglutinin__InfluenzaB__AHL92750

SEQ ID NO: 27995 - protein, 584 aa, Artificial Sequence; identical to SEQ ID NO: 26820
  hemagglutinin__InfluenzaB__AHL92761

SEQ ID NO: 27996 - protein, 584 aa, Artificial Sequence
  hemagglutinin__InfluenzaB__AHL92772
MKAIIVLLMVVTSNADRICTGITSSNSPHVVKTATQGEVNVTGVIPLTTTPTKSYFANLKGTRTRGKLCPDCLNCTDLDVALGRPMCMGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 27997 - protein, 584 aa, Artificial Sequence; identical to SEQ ID NO: 26820
  hemagglutinin__InfluenzaB__AHL92794

SEQ ID NO: 27998 - protein, 584 aa, Artificial Sequence; identical to SEQ ID NO: 26820
  hemagglutinin__InfluenzaB__AHL92805

SEQ ID NO: 27999 - protein, 584 aa, Artificial Sequence; identical to SEQ ID NO: 26820
  hemagglutinin__InfluenzaB__AHL92816

SEQ ID NO: 28000 - protein, 584 aa, Artificial Sequence
  hemagglutinin__InfluenzaB__AHL92827
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFVVYMVSRDNVSCSICL

SEQ ID NO: 28001 - protein, 584 aa, Artificial Sequence; identical to SEQ ID NO: 26820
  hemagglutinin__InfluenzaB__AHL92838

SEQ ID NO: 28002 - protein, 584 aa, Artificial Sequence; identical to SEQ ID NO: 26820
  hemagglutinin__InfluenzaB__AHL92849

SEQ ID NO: 28003 - protein, 584 aa, Artificial Sequence; identical to SEQ ID NO: 26820
  hemagglutinin__InfluenzaB__AHL92860

SEQ ID NO: 28004 - protein, 585 aa, Artificial Sequence; identical to SEQ ID NO: 26638
  hemagglutinin__InfluenzaB__AHL92871

SEQ ID NO: 28005 - protein, 584 aa, Artificial Sequence; identical to SEQ ID NO: 26426
  hemagglutinin__InfluenzaB__AHL92882

SEQ ID NO: 28006 - protein, 585 aa, Artificial Sequence
  hemagglutinin__InfluenzaB__AHL92893
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDKETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFIVYMVSRDNVSCSICL

SEQ ID NO: 28007 - protein, 584 aa, Artificial Sequence; identical to SEQ ID NO: 27023
  hemagglutinin__InfluenzaB__AHL92904

SEQ ID NO: 28008 - protein, 585 aa, Artificial Sequence
  hemagglutinin__InfluenzaB__AHL92915
MKAIIVLLMVVTSNADRICTGITSSNSPHVVKTATQGEVNVTGVIPLTTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFIVYMVSRDNVSCSICL

SEQ ID NO: 28009 - protein, 585 aa, Artificial Sequence; identical to SEQ ID NO: 26638
  hemagglutinin__InfluenzaB__AHL92926

SEQ ID NO: 28010 - protein, 584 aa, Artificial Sequence; identical to SEQ ID NO: 27599
  hemagglutinin__InfluenzaB__AHL92937

SEQ ID NO: 28011 - protein, 585 aa, Artificial Sequence; identical to SEQ ID NO: 26514
  hemagglutinin__InfluenzaB__AHL92948

SEQ ID NO: 28012 - protein, 585 aa, Artificial Sequence; identical to SEQ ID NO: 26514
  hemagglutinin__InfluenzaB__AHL92959

SEQ ID NO: 28013 - protein, 585 aa, Artificial Sequence; identical to SEQ ID NO: 26514
  hemagglutinin__InfluenzaB__AHL92970

SEQ ID NO: 28014 - protein, 585 aa, Artificial Sequence; identical to SEQ ID NO: 26514
  hemagglutinin__InfluenzaB__AHL92981

SEQ ID NO: 28015 - protein, 585 aa, Artificial Sequence; identical to SEQ ID NO: 26514
  hemagglutinin__InfluenzaB__AHL92992

SEQ ID NO: 28016 - protein, 585 aa, Artificial Sequence; identical to SEQ ID NO: 27939
  hemagglutinin__InfluenzaB__AHL93004

SEQ ID NO: 28017 - protein, 585 aa, Artificial Sequence; identical to SEQ ID NO: 26514
  hemagglutinin__InfluenzaB__AHL93015

SEQ ID NO: 28018 - protein, 585 aa, Artificial Sequence; identical to SEQ ID NO: 26514
  hemagglutinin__InfluenzaB__AHL93026

SEQ ID NO: 28019 - protein, 584 aa, Artificial Sequence; identical to SEQ ID NO: 27963
  hemagglutinin__InfluenzaB__AHL93037

SEQ ID NO: 28020 - protein, 584 aa, Artificial Sequence; identical to SEQ ID NO: 27963
  hemagglutinin__InfluenzaB__AHL93048

SEQ ID NO: 28021 - protein, 584 aa, Artificial Sequence; identical to SEQ ID NO: 27992
  hemagglutinin__InfluenzaB__AHL93059

SEQ ID NO: 28022 - protein, 584 aa, Artificial Sequence; identical to SEQ ID NO: 26820
  hemagglutinin__InfluenzaB__AHL93070

SEQ ID NO: 28023 - protein, 584 aa, Artificial Sequence
  hemagglutinin__InfluenzaB__AHL93081
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDGKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28024 - protein, 584 aa, Artificial Sequence; identical to SEQ ID NO: 26820
  hemagglutinin__InfluenzaB__AHL93092

SEQ ID NO: 28025 - protein, 584 aa, Artificial Sequence; identical to SEQ ID NO: 26820
  hemagglutinin__InfluenzaB__AHL93103

SEQ ID NO: 28026 - protein, 584 aa, Artificial Sequence; identical to SEQ ID NO: 26820
  hemagglutinin__InfluenzaB__AHL93114

SEQ ID NO: 28027 - protein, 584 aa, Artificial Sequence; identical to SEQ ID NO: 26567
  hemagglutinin__InfluenzaB__AHL93125

SEQ ID NO: 28028 - protein, 584 aa, Artificial Sequence
  hemagglutinin__InfluenzaB__AHL93136
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKPGKTGTIVYQRGVLLPQRVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28029 - protein, 584 aa, Artificial Sequence; identical to SEQ ID NO: 26567
  hemagglutinin__InfluenzaB__AHL93147

SEQ ID NO: 28030 - protein, 584 aa, Artificial Sequence; identical to SEQ ID NO: 26820
  hemagglutinin__InfluenzaB__AHL93158

SEQ ID NO: 28031 - protein, 584 aa, Artificial Sequence
  hemagglutinin__InfluenzaB__AHL93169
MKAIIVLLMVVTSNADRICTGITSSNSPHVVKTATQGEVNVTGVIPLTTTPTKSYFANLKGTRTRGKLCPDCFNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28032 - protein, 584 aa, Artificial Sequence
  hemagglutinin__InfluenzaB__AHL93180
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIIHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDNKTQMKNLYGDSNPQKFTSSANGVTTHYVSQIGSFPDQTEDGGLPQSGRIVVDYMMQKPGKTGTIVYQRGVLLPQRVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28033 - protein, 584 aa, Artificial Sequence
  hemagglutinin__InfluenzaB__AHL93191
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNDTSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28034 - protein, 584 aa, Artificial Sequence
  hemagglutinin__InfluenzaB__AHL93202
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDEFHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28035 - protein, 585 aa, Artificial Sequence; identical to SEQ ID NO: 26989
  hemagglutinin__InfluenzaB__AHL93213

SEQ ID NO: 28036 - protein, 585 aa, Artificial Sequence; identical to SEQ ID NO: 26989
  hemagglutinin__InfluenzaB__AHL93224

SEQ ID NO: 28037 - protein, 585 aa, Artificial Sequence
  hemagglutinin__InfluenzaB__AHL93235
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNNDGLDNHTILLYYSTAASSLAVTLMIAIFVVYMVSRDNVSCSICL

SEQ ID NO: 28038 - protein, 585 aa, Artificial Sequence
  hemagglutinin__InfluenzaB__AHL93246
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNSLTIEVPYICTEGEDQITIWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLGELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28039 - protein, 585 aa, Artificial Sequence; identical to SEQ ID NO: 26989
  hemagglutinin__InfluenzaB__AHL93257

SEQ ID NO: 28040 - protein, 585 aa, Artificial Sequence; identical to SEQ ID NO: 27322
  hemagglutinin__InfluenzaB__AHL93268

SEQ ID NO: 28041 - protein, 585 aa, Artificial Sequence
  hemagglutinin__InfluenzaB__AHL93279
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGKSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28042 - protein, 585 aa, Artificial Sequence; identical to SEQ ID NO: 26989
  hemagglutinin__InfluenzaB__AHL93290

SEQ ID NO: 28043 - protein, 585 aa, Artificial Sequence
  hemagglutinin__InfluenzaB__AHL93301
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMIAIFVVYMVSRDNVSCSICL

SEQ ID NO: 28044 - protein, 585 aa, Artificial Sequence
  hemagglutinin__InfluenzaB__AHL93312
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFYATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28045 - protein, 585 aa, Artificial Sequence
  hemagglutinin__InfluenzaB__AHL93323
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCTSGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28046 - protein, 585 aa, Artificial Sequence
  hemagglutinin__InfluenzaB__AHL93334
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCTSGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28047 - protein, 585 aa, Artificial Sequence; identical to SEQ ID NO: 26989
  hemagglutinin__InfluenzaB__AHL93345

SEQ ID NO: 28048 - protein, 585 aa, Artificial Sequence; identical to SEQ ID NO: 26989
  hemagglutinin__InfluenzaB__AHL93356

SEQ ID NO: 28049 - protein, 585 aa, Artificial Sequence
  hemagglutinin__InfluenzaB__AHL93367
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEYIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28050 - protein, 585 aa, Artificial Sequence; identical to SEQ ID NO: 26989
  hemagglutinin__InfluenzaB__AHL93378

SEQ ID NO: 28051 - protein, 585 aa, Artificial Sequence
  hemagglutinin__InfluenzaB__AHL93389
MKAIIVLLMVVTSNADRICTGITSSNSPHVVKTATQGEVNVTGVIPLTTTPTKSYFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28052 - protein, 585 aa, Artificial Sequence; identical to SEQ ID NO: 26989
  hemagglutinin__InfluenzaB__AHL93400

SEQ ID NO: 28053 - protein, 585 aa, Artificial Sequence; identical to SEQ ID NO: 27322
  hemagglutinin__InfluenzaB__AHL93411

SEQ ID NO: 28054 - protein, 585 aa, Artificial Sequence; identical to SEQ ID NO: 27322
  hemagglutinin__InfluenzaB__AHL93422

SEQ ID NO: 28055 - protein, 585 aa, Artificial Sequence; identical to SEQ ID NO: 27322
  hemagglutinin__InfluenzaB__AHL93433

SEQ ID NO: 28056 - protein, 585 aa, Artificial Sequence; identical to SEQ ID NO: 26989
  hemagglutinin__InfluenzaB__AHL93444

SEQ ID NO: 28057 - protein, 585 aa, Artificial Sequence
  hemagglutinin__InfluenzaB__AHL93455
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMNELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28058 - protein, 585 aa, Artificial Sequence; identical to SEQ ID NO: 26989
  hemagglutinin__InfluenzaB__AHL93466

SEQ ID NO: 28059 - protein, 585 aa, Artificial Sequence; identical to SEQ ID NO: 26608
  hemagglutinin__InfluenzaB__AHL93477

SEQ ID NO: 28060 - protein, 585 aa, Artificial Sequence; identical to SEQ ID NO: 26683
  hemagglutinin__InfluenzaB__AHL93488

SEQ ID NO: 28061 - protein, 584 aa, Artificial Sequence
  hemagglutinin__InfluenzaB__AHL93499
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEIRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTAHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28062 - protein, 585 aa, Artificial Sequence; identical to SEQ ID NO: 26608
  hemagglutinin__InfluenzaB__AHL93510

SEQ ID NO: 28063 - protein, 584 aa, Artificial Sequence
  hemagglutinin__InfluenzaB__AHL93521
MKAIIALLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQRFTSSANGVTTHYVSQIGDFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28064 - protein, 585 aa, Artificial Sequence; identical to SEQ ID NO: 26683
  hemagglutinin__InfluenzaB__AHL93532

SEQ ID NO: 28065 - protein, 585 aa, Artificial Sequence; identical to SEQ ID NO: 26645
  hemagglutinin__InfluenzaB__AHL93543

SEQ ID NO: 28066 - protein, 585 aa, Artificial Sequence; identical to SEQ ID NO: 26645
  hemagglutinin__InfluenzaB__AHL93554

SEQ ID NO: 28067 - protein, 585 aa, Artificial Sequence; identical to SEQ ID NO: 26645
  hemagglutinin__InfluenzaB__AHL93565

SEQ ID NO: 28068 - protein, 585 aa, Artificial Sequence; identical to SEQ ID NO: 26683
  hemagglutinin__InfluenzaB__AHL93576

SEQ ID NO: 28069 - protein, 585 aa, Artificial Sequence; identical to SEQ ID NO: 26683
  hemagglutinin__InfluenzaB__AHL93587

SEQ ID NO: 28070 - protein, 585 aa, Artificial Sequence
  hemagglutinin__InfluenzaB__AHL93609
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLTERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28071 - protein, 585 aa, Artificial Sequence; identical to SEQ ID NO: 26683
  hemagglutinin__InfluenzaB__AHL93620

SEQ ID NO: 28072 - protein, 585 aa, Artificial Sequence; identical to SEQ ID NO: 28070
  hemagglutinin__InfluenzaB__AHL93631

SEQ ID NO: 28073 - protein, 585 aa, Artificial Sequence; identical to SEQ ID NO: 28070
  hemagglutinin__InfluenzaB__AHL93642

SEQ ID NO: 28074 - protein, 584 aa, Artificial Sequence
  hemagglutinin__InfluenzaB__AHL93653
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMVQKPGKTGTIVYQRGVLLPQKVWCASGRSKVIKGSLPLIGEADCLHEKYGGLNKSKPYYTGEHAKAIGDCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28075 - protein, 585 aa, Artificial Sequence; identical to SEQ ID NO: 26683
  hemagglutinin__InfluenzaB__AHL93664

SEQ ID NO: 28076 - protein, 585 aa, Artificial Sequence; identical to SEQ ID NO: 26608
  hemagglutinin__InfluenzaB__AHL93675

SEQ ID NO: 28077 - protein, 585 aa, Artificial Sequence; identical to SEQ ID NO: 28070
  hemagglutinin__InfluenzaB__AHL93686

SEQ ID NO: 28078 - protein, 585 aa, Artificial Sequence; identical to SEQ ID NO: 28070
  hemagglutinin__InfluenzaB__AHL93697

SEQ ID NO: 28079 - protein, 585 aa, Artificial Sequence
  hemagglutinin__InfluenzaB__AHL93708
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGKHAKAIGNCPIWVKTPLKLANGTKYRPPAKLLTERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28080 - protein, 585 aa, Artificial Sequence
  hemagglutinin__InfluenzaB__AHL93719
MKAIIVLLMVVTSNADRICTGITSSNSPHIVKTATQGEVNVTGVIPLTTTPTKSHFANLKGTETRGKLCPKCLNCTDLDVALGRPKCTGKIPSARVSILHEVIPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28081 - protein, 585 aa, Artificial Sequence; identical to SEQ ID NO: 26683
  hemagglutinin__InfluenzaB__AHL93730

SEQ ID NO: 28082 - protein, 585 aa, Artificial Sequence; identical to SEQ ID NO: 26683
  hemagglutinin__InfluenzaB__AHL93741

SEQ ID NO: 28083 - protein, 585 aa, Artificial Sequence; identical to SEQ ID NO: 26645
  hemagglutinin__InfluenzaB__AHL93752

SEQ ID NO: 28084 - protein, 585 aa, Artificial Sequence; identical to SEQ ID NO: 28070
  hemagglutinin__InfluenzaB__AHL93763

SEQ ID NO: 28085 - protein, 585 aa, Artificial Sequence; identical to SEQ ID NO: 26608
  hemagglutinin__InfluenzaB__AHL93774

SEQ ID NO: 28086 - protein, 585 aa, Artificial Sequence; identical to SEQ ID NO: 28070
  hemagglutinin__InfluenzaB__AHL93785

SEQ ID NO: 28087 - protein, 585 aa, Artificial Sequence; identical to SEQ ID NO: 26683
  hemagglutinin__InfluenzaB__AHL93796

SEQ ID NO: 28088 - protein, 585 aa, Artificial Sequence; identical to SEQ ID NO: 26608
  hemagglutinin__InfluenzaB__AHL93818

SEQ ID NO: 28089 - protein, 585 aa, Artificial Sequence
  hemagglutinin__InfluenzaB__AHL93829
MKAIIVLLMVVTSNADRICTGITSSNSPHIVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINTENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28090 - protein, 585 aa, Artificial Sequence; identical to SEQ ID NO: 26989
  hemagglutinin__InfluenzaB__AHL93840

SEQ ID NO: 28091 - protein, 585 aa, Artificial Sequence; identical to SEQ ID NO: 26683
  hemagglutinin__InfluenzaB__AHL93851

SEQ ID NO: 28092 - protein, 585 aa, Artificial Sequence; identical to SEQ ID NO: 26683
  hemagglutinin__InfluenzaB__AHL93862

SEQ ID NO: 28093 - protein, 585 aa, Artificial Sequence
  hemagglutinin__InfluenzaB__AHL93873
MKAIIVLLMVVTSNADRICTGITSSNSPHIVKTATQGEVNVTGVIPLTTTPTKSHFANLKGTETRGELCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28094 - protein, 585 aa, Artificial Sequence; identical to SEQ ID NO: 26683
  hemagglutinin__InfluenzaB__AHL93884

SEQ ID NO: 28095 - protein, 585 aa, Artificial Sequence; identical to SEQ ID NO: 26683
  hemagglutinin__InfluenzaB__AHL93895

SEQ ID NO: 28096 - protein, 585 aa, Artificial Sequence; identical to SEQ ID NO: 26683
  hemagglutinin__InfluenzaB__AHL93906

SEQ ID NO: 28097 - protein, 585 aa, Artificial Sequence; identical to SEQ ID NO: 26683
  hemagglutinin__InfluenzaB__AHL93917

SEQ ID NO: 28098 - protein, 585 aa, Artificial Sequence; identical to SEQ ID NO: 26608
  hemagglutinin__InfluenzaB__AHL93928

SEQ ID NO: 28099 - protein, 585 aa, Artificial Sequence; identical to SEQ ID NO: 26645
  hemagglutinin__InfluenzaB__AHL93939

SEQ ID NO: 28100 - protein, 585 aa, Artificial Sequence; identical to SEQ ID NO: 26683
  hemagglutinin__InfluenzaB__AHL93950

SEQ ID NO: 28101 - protein, 585 aa, Artificial Sequence; identical to SEQ ID NO: 26645
  hemagglutinin__InfluenzaB__AHL93961

SEQ ID NO: 28102 - protein, 585 aa, Artificial Sequence
  hemagglutinin__InfluenzaB__AHL93972
MKAIIVLLMVVTSTADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAVGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28103 - protein, 585 aa, Artificial Sequence; identical to SEQ ID NO: 26608
  hemagglutinin__InfluenzaB__AHL93983

SEQ ID NO: 28104 - protein, 584 aa, Artificial Sequence
  hemagglutinin__InfluenzaB__AHL93994
MKAIIVLLMVVTSNADRICTGITSSNSPHVVKTATQGEVNVTGVIPLTTTPKKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMISRDNVSCSICL

SEQ ID NO: 28105 - protein, 585 aa, Artificial Sequence; identical to SEQ ID NO: 26683
  hemagglutinin__InfluenzaB__AHL94005

SEQ ID NO: 28106 - protein, 585 aa, Artificial Sequence; identical to SEQ ID NO: 26683
  hemagglutinin__InfluenzaB__AHL94016

SEQ ID NO: 28107 - protein, 585 aa, Artificial Sequence
  hemagglutinin__InfluenzaB__AHL94027
MKAIIVLLMVVTSNADRICTGITSSNSPHIVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQMGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28108 - protein, 585 aa, Artificial Sequence; identical to SEQ ID NO: 26645
  hemagglutinin__InfluenzaB__AHL94038

SEQ ID NO: 28109 - protein, 585 aa, Artificial Sequence; identical to SEQ ID NO: 26608
  hemagglutinin__InfluenzaB__AHL94049

SEQ ID NO: 28110 - protein, 585 aa, Artificial Sequence; identical to SEQ ID NO: 26683
  hemagglutinin__InfluenzaB__AHL94060

SEQ ID NO: 28111 - protein, 585 aa, Artificial Sequence
  hemagglutinin__InfluenzaB__AHL94071
MKAIIVLLMVVTSNADRICTGITSSNSPHIVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMMQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAISKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28112 - protein, 584 aa, Artificial Sequence
  hemagglutinin__InfluenzaB__AHL94082
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEIRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28113 - protein, 585 aa, Artificial Sequence; identical to SEQ ID NO: 26645
  hemagglutinin__InfluenzaB__AHL94093

SEQ ID NO: 28114 - protein, 585 aa, Artificial Sequence; identical to SEQ ID NO: 26683
  hemagglutinin__InfluenzaB__AHL94102

SEQ ID NO: 28115 - protein, 585 aa, Artificial Sequence
  hemagglutinin__InfluenzaB__AHL94113
MKAIIVLLMVVTSNADRICTGITSSNSPHIVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCLNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28116 - protein, 585 aa, Artificial Sequence
  hemagglutinin__InfluenzaB__AHL94124
MKAIIVLLMVVTSNADRICTGITSSNSPHIVKTATQGEVNVTGVIPLTTTPTKSHFANLKGTETRGKLCPKCLNCTDLDVALGRPKCTGKIPSARVSILHEIRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28117 - protein, 585 aa, Artificial Sequence; identical to SEQ ID NO: 26608
  hemagglutinin__InfluenzaB__AHL94135

SEQ ID NO: 28118 - protein, 585 aa, Artificial Sequence; identical to SEQ ID NO: 26608
  hemagglutinin__InfluenzaB__AHL94146

SEQ ID NO: 28119 - protein, 585 aa, Artificial Sequence; identical to SEQ ID NO: 26683
  hemagglutinin__InfluenzaB__AHL94157

SEQ ID NO: 28120 - protein, 585 aa, Artificial Sequence; identical to SEQ ID NO: 26683
  hemagglutinin__InfluenzaB__AHL94168

SEQ ID NO: 28121 - protein, 585 aa, Artificial Sequence; identical to SEQ ID NO: 26608
  hemagglutinin__InfluenzaB__AHL94179

SEQ ID NO: 28122 - protein, 585 aa, Artificial Sequence; identical to SEQ ID NO: 26608
  hemagglutinin__InfluenzaB__AHL94190

SEQ ID NO: 28123 - protein, 585 aa, Artificial Sequence
  hemagglutinin__InfluenzaB__AHL94201
MKAIIVLLMVVTSNADRICTGITSSNSPHIVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFETMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRNNVSCSICL

SEQ ID NO: 28124 - protein, 585 aa, Artificial Sequence
  hemagglutinin__InfluenzaB__AHL94212
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQVTVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28125 - protein, 585 aa, Artificial Sequence; identical to SEQ ID NO: 26683
  hemagglutinin__InfluenzaB__AHL94220

SEQ ID NO: 28126 - protein, 585 aa, Artificial Sequence; identical to SEQ ID NO: 26683
  hemagglutinin__InfluenzaB__AHL94231

SEQ ID NO: 28127 - protein, 585 aa, Artificial Sequence
  hemagglutinin__InfluenzaB__AHL94242
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCANGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28128 - protein, 585 aa, Artificial Sequence; identical to SEQ ID NO: 26645
  hemagglutinin__InfluenzaB__AHL94253

SEQ ID NO: 28129 - protein, 584 aa, Artificial Sequence
  hemagglutinin__InfluenzaB__AHL94274
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28130 - protein, 584 aa, Artificial Sequence; identical to SEQ ID NO: 28129
  hemagglutinin__InfluenzaB__AHL94295

SEQ ID NO: 28131 - protein, 584 aa, Artificial Sequence
  hemagglutinin__InfluenzaB__AHL94306
MKAIIVLLMVVTSNADRICTGITSSNSPHVVKTATQGEVNVTGAIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPQTVEVPYICTEGEDQITVWGFHSDNKTQMKNLYGDSNPQKFTSSANGVTTHYVSQIGDFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28132 - protein, 584 aa, Artificial Sequence
  hemagglutinin__InfluenzaB__AHL94317
MKAIIVLLMVVTSNADRICTGITSSNSPHVVKTATQGEVNVTGAIPLTTTPTKSYFANLKGIRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPRDNYKNATNPQTVEVPYICTEGEDQITVWGFHSDNKTQMKNLYGDSNPQKFTSSANGVTTHYVSQIGDFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28133 - protein, 584 aa, Artificial Sequence; identical to SEQ ID NO: 28131
  hemagglutinin__InfluenzaB__AHL94328

SEQ ID NO: 28134 - protein, 584 aa, Artificial Sequence; identical to SEQ ID NO: 28129
  hemagglutinin__InfluenzaB__AHL94339

SEQ ID NO: 28135 - protein, 585 aa, Artificial Sequence
  hemagglutinin__InfluenzaB__AHL94350
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSNPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSKDNVSCSICL

SEQ ID NO: 28136 - protein, 585 aa, Artificial Sequence
  hemagglutinin__InfluenzaB__AHL94361
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSNPQKFTSSANGVTTHYVSQIGGFPNQTEDGGLPQSGRIVVDYMVQKSGKTGTIAYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDSVSCSICL

SEQ ID NO: 28137 - protein, 585 aa, Artificial Sequence
  hemagglutinin__InfluenzaB__AHL94383
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMEKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28138 - protein, 585 aa, Artificial Sequence; identical to SEQ ID NO: 26645
  hemagglutinin__InfluenzaB__AHL94394

SEQ ID NO: 28139 - protein, 585 aa, Artificial Sequence
  hemagglutinin__InfluenzaB__AHL94405
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMIAIFVVYMVSRDNVSCSICL

SEQ ID NO: 28140 - protein, 585 aa, Artificial Sequence; identical to SEQ ID NO: 26645
  hemagglutinin__InfluenzaB__AHL94416

SEQ ID NO: 28141 - protein, 584 aa, Artificial Sequence; identical to SEQ ID NO: 26854
  hemagglutinin__InfluenzaB__AHL94427

SEQ ID NO: 28142 - protein, 584 aa, Artificial Sequence
  hemagglutinin__InfluenzaB__AHL94438
MKAIIVLLMVVTSNADRICTGITSSNSPHVVKTATQGEVNVTGAIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFETMAWAVPKDNYKNATNPQTVEVPYICTEGEDQITVWGFHSDNKTQMKNLYGDSNPQKFTSSANGVTTHYVSQIGDFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28143 - protein, 584 aa, Artificial Sequence
  hemagglutinin__InfluenzaB__AHL94460
MKAIIVLLMVVTSNADRICTGITSSNSPHVVKTATQGEVNVTGAIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPQTVEVPYICTEEEDQITVWGFHSDNKTQMKNLYGDSNPQKFTSSANGVTTHYVSQIGDFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28144 - protein, 584 aa, Artificial Sequence
  hemagglutinin__InfluenzaB__AHL94471
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNISCSICL

SEQ ID NO: 28145 - protein, 585 aa, Artificial Sequence
  hemagglutinin__InfluenzaB__AHL94482
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFTTMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28146 - protein, 584 aa, Artificial Sequence; identical to SEQ ID NO: 28129
  hemagglutinin__InfluenzaB__AHL94493

SEQ ID NO: 28147 - protein, 584 aa, Artificial Sequence; identical to SEQ ID NO: 28131
  hemagglutinin__InfluenzaB__AHL94504

SEQ ID NO: 28148 - protein, 585 aa, Artificial Sequence
  hemagglutinin__InfluenzaB__AHL94515
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTYNVINAEDAPGGPYKIGTSGSCPNVTNGNGFFATMAWAVPKNDKNKTATNPLTIEVPYICTEGEDQITVWGFHSDNETQMEKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28149 - protein, 584 aa, Artificial Sequence; identical to SEQ ID NO: 28131
  hemagglutinin__InfluenzaB__AHL94526

SEQ ID NO: 28150 - protein, 585 aa, Artificial Sequence
  hemagglutinin__InfluenzaB__AHL94537
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSNPQKFTSSANGVTTHYISQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28151 - protein, 584 aa, Artificial Sequence
  hemagglutinin__InfluenzaB__AHL94548
MKAIIVLLMVVTSNADRICTGITSSNSPHVVKTATQGEVNVTGVIPLTTTPIKSYFANLKGTKTRGKLCPDCLNCTDLDVALGRPMCVGTTPSAKASILHEVRPVTSGCFPIMHDRTKIRQLANLLRGYENIRLSTQNVIDAERAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28152 - protein, 584 aa, Artificial Sequence; identical to SEQ ID NO: 28129
  hemagglutinin__InfluenzaB__AHL94559

SEQ ID NO: 28153 - protein, 584 aa, Artificial Sequence; identical to SEQ ID NO: 26854
  hemagglutinin__InfluenzaB__AHL94570

SEQ ID NO: 28154 - protein, 584 aa, Artificial Sequence; identical to SEQ ID NO: 26854
  hemagglutinin__InfluenzaB__AHL94581

SEQ ID NO: 28155 - protein, 584 aa, Artificial Sequence; identical to SEQ ID NO: 26854
  hemagglutinin__InfluenzaB__AHL94592

SEQ ID NO: 28156 - protein, 585 aa, Artificial Sequence
  hemagglutinin__InfluenzaB__AHL94603
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYENIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28157 - protein, 585 aa, Artificial Sequence
  hemagglutinin__InfluenzaB__AHL94614
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYISHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28158 - protein, 584 aa, Artificial Sequence; identical to SEQ ID NO: 28131
  hemagglutinin__InfluenzaB__AHL94624

SEQ ID NO: 28159 - protein, 585 aa, Artificial Sequence
  hemagglutinin__InfluenzaB__AHL94646
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCLNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28160 - protein, 585 aa, Artificial Sequence
  hemagglutinin__InfluenzaB__AHL94657
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAESAPGGPYKIGTSGSCPNVTNGNGFFATMAWAVPKNDKNKTATDPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28161 - protein, 584 aa, Artificial Sequence; identical to SEQ ID NO: 28131
  hemagglutinin__InfluenzaB__AHL94668

SEQ ID NO: 28162 - protein, 584 aa, Artificial Sequence; identical to SEQ ID NO: 28131
  hemagglutinin__InfluenzaB__AHL94679

SEQ ID NO: 28163 - protein, 585 aa, Artificial Sequence; identical to SEQ ID NO: 28156
  hemagglutinin__InfluenzaB__AHL94690

SEQ ID NO: 28164 - protein, 585 aa, Artificial Sequence
  hemagglutinin__InfluenzaB__AHL94701
MKAIIVLLMVVTSNADRICTGITSSNSPHVVKTATQGEVNVTGVIPLTTTLTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCLNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28165 - protein, 584 aa, Artificial Sequence; identical to SEQ ID NO: 28129
  hemagglutinin__InfluenzaB__AHL94712

SEQ ID NO: 28166 - protein, 585 aa, Artificial Sequence; identical to SEQ ID NO: 28160
  hemagglutinin__InfluenzaB__AHL94723

SEQ ID NO: 28167 - protein, 584 aa, Artificial Sequence; identical to SEQ ID NO: 28129
  hemagglutinin__InfluenzaB__AHL94734

SEQ ID NO: 28168 - protein, 585 aa, Artificial Sequence
  hemagglutinin__InfluenzaB__AHL94745
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCLNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNGDGLDNHTILLYYSTAASSLAVTLMIAIFVVYMVSRDNVSCSICL

SEQ ID NO: 28169 - protein, 584 aa, Artificial Sequence; identical to SEQ ID NO: 26854
  hemagglutinin__InfluenzaB__AHL94756

SEQ ID NO: 28170 - protein, 585 aa, Artificial Sequence; identical to SEQ ID NO: 28159
  hemagglutinin__InfluenzaB__AHL94766

SEQ ID NO: 28171 - protein, 584 aa, Artificial Sequence
  hemagglutinin__InfluenzaB__AHL94777
MKAIIVLLMVVTSNADRICTGITSSNSPHVVKTATQGEVNVTGAIPLTTTPTKSYFANLKGTRTRGKLCPDCFNCTDLDVALGRPMCVGTTPSAKASILHEVRPVTSGCFPIMHDRTKIRQLPNLLRGYENIRLSTQNAIDAEKAPGGPYRLGTSGSCPNATSKIGFFATMAWAVPKDNYKNATNPQTVEVPYICTEGEDQITVWGFHSDNKTQMKNLYGDSNPQKFTSSANGVTTHYVSQIGDFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28172 - protein, 585 aa, Artificial Sequence; identical to SEQ ID NO: 28156
  hemagglutinin__InfluenzaB__AHL94797

SEQ ID NO: 28173 - protein, 584 aa, Artificial Sequence
  hemagglutinin__InfluenzaB__AHL94808
MKAIIVLLMVVTSNADRICTGITSSNSPHVVKTATQGEVNVTGAIPLTTTPTKSYFANLKGIRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPQTVEVPYICTEGEDQITVWGFHSDNKTQMKNLYGDSNPQKFTSSANGVTTHYVSQIGDFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28174 - protein, 584 aa, Artificial Sequence
  hemagglutinin__InfluenzaB__AHL94817
MKAIIVLLMVVTSNADRICTGITSSNSPHVVKTATQGEVNVTGAIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPQTVEVPYICTEGEDQITVWGFHSDNKTQMKNLYGDSNPQKFTSSANGVTTHYVSQIGDFPDQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEIIELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28175 - protein, 585 aa, Artificial Sequence; identical to SEQ ID NO: 27865
  hemagglutinin__InfluenzaB__AHL94827

SEQ ID NO: 28176 - protein, 584 aa, Artificial Sequence
  hemagglutinin__InfluenzaB__AHL94837
MKAIIVLLMVVTSNADRICTGITSSNSPHVVKTATQGEVNVTGVIPLTTTPAKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYKLGTSGSCPNATSKIGFFATMAWAVPKDNYKNATNPLTVEVPYICKEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28177 - protein, 584 aa, Artificial Sequence; identical to SEQ ID NO: 26854
  hemagglutinin__InfluenzaB__AHL94847

SEQ ID NO: 28178 - protein, 585 aa, Artificial Sequence
  hemagglutinin__InfluenzaB__AHL94858
MKAIIVLLMVVTSNADRICTGITSSNSPHVVKTATQGEVNVTGVIPLTTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGPYKIGTSGSCPNVTNGNGFFATMAWAVPKNDNNKTATNSLTIEVPYICTEGEDQITVWGFHSDNETQMAKLYGDSKPQKFTSSANGVTTHYVSQIGGFPNQTEDGGLPQSGRIVVDYMVQKSGKAGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28179 - protein, 584 aa, Artificial Sequence; identical to SEQ ID NO: 26820
  hemagglutinin__InfluenzaB__AHL94869

SEQ ID NO: 28180 - protein, 585 aa, Artificial Sequence; identical to SEQ ID NO: 26989
  hemagglutinin__InfluenzaB__AHL94880

SEQ ID NO: 28181 - protein, 585 aa, Artificial Sequence; identical to SEQ ID NO: 27322
  hemagglutinin__InfluenzaB__AHL94889

SEQ ID NO: 28182 - protein, 585 aa, Artificial Sequence; identical to SEQ ID NO: 26989
  hemagglutinin__InfluenzaB__AHL94900

SEQ ID NO: 28183 - protein, 585 aa, Artificial Sequence
  hemagglutinin__InfluenzaB__AHL94911
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGRTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28184 - protein, 585 aa, Artificial Sequence; identical to SEQ ID NO: 26989
  hemagglutinin__InfluenzaB__AHL94922

SEQ ID NO: 28185 - protein, 585 aa, Artificial Sequence
  hemagglutinin__InfluenzaB__AHL94933
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKAGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28186 - protein, 585 aa, Artificial Sequence; identical to SEQ ID NO: 28070
  hemagglutinin__InfluenzaB__AHL94944

SEQ ID NO: 28187 - protein, 585 aa, Artificial Sequence; identical to SEQ ID NO: 26683
  hemagglutinin__InfluenzaB__AHL94955

SEQ ID NO: 28188 - protein, 585 aa, Artificial Sequence; identical to SEQ ID NO: 26683
  hemagglutinin__InfluenzaB__AHL94965

SEQ ID NO: 28189 - protein, 585 aa, Artificial Sequence; identical to SEQ ID NO: 26683
  hemagglutinin__InfluenzaB__AHL94975

SEQ ID NO: 28190 - protein, 584 aa, Artificial Sequence; identical to SEQ ID NO: 26854
  hemagglutinin__InfluenzaB__AHM00986

SEQ ID NO: 28191 - protein, 585 aa, Artificial Sequence; identical to SEQ ID NO: 26887
  hemagglutinin__InfluenzaB__AHM00997

SEQ ID NO: 28192 - protein, 585 aa, Artificial Sequence
  hemagglutinin__InfluenzaB__AHM01008
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAEDAPGGPYKIGTSGSCPNVTNGNGFFATMAWTVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28193 - protein, 585 aa, Artificial Sequence; identical to SEQ ID NO: 26887
  hemagglutinin__InfluenzaB__AHM01019

SEQ ID NO: 28194 - protein, 585 aa, Artificial Sequence; identical to SEQ ID NO: 26887
  hemagglutinin__InfluenzaB__AHM01030

SEQ ID NO: 28195 - protein, 585 aa, Artificial Sequence
  hemagglutinin__InfluenzaB__AHM01041
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAEDAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSEKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28196 - protein, 585 aa, Artificial Sequence
  hemagglutinin__InfluenzaB__AHM01052
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTIMLYYSTAASSLAVTLMIAIFVVYMVSRDNVSCSICL

SEQ ID NO: 28197 - protein, 585 aa, Artificial Sequence; identical to SEQ ID NO: 26887
  hemagglutinin__InfluenzaB__AHM01063

SEQ ID NO: 28198 - protein, 584 aa, Artificial Sequence; identical to SEQ ID NO: 26854
  hemagglutinin__InfluenzaB__AHM01074

SEQ ID NO: 28199 - protein, 584 aa, Artificial Sequence
  hemagglutinin__InfluenzaB__AHM01096
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQIGGFPDQTEDGGLPQSGRIVVDYMMQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28200 - protein, 585 aa, Artificial Sequence; identical to SEQ ID NO: 26887
  hemagglutinin__InfluenzaB__AHM01107

SEQ ID NO: 28201 - protein, 585 aa, Artificial Sequence
  hemagglutinin__InfluenzaB__AHM01118
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAEDAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAVSLNDDGLDNHTILLYYSTAASSLAVTLMIAIFVVYMVSRDNVSCSICL

SEQ ID NO: 28202 - protein, 585 aa, Artificial Sequence; identical to SEQ ID NO: 26887
  hemagglutinin__InfluenzaB__AHM01129

SEQ ID NO: 28203 - protein, 585 aa, Artificial Sequence
  hemagglutinin__InfluenzaB__AHM01140
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSAHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28204 - protein, 585 aa, Artificial Sequence; identical to SEQ ID NO: 26872
  hemagglutinin__InfluenzaB__AHM01151

SEQ ID NO: 28205 - protein, 585 aa, Artificial Sequence
  hemagglutinin__InfluenzaB__AHM01162
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAKDAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28206 - protein, 584 aa, Artificial Sequence; identical to SEQ ID NO: 26854
  hemagglutinin__InfluenzaB__AHM01173

SEQ ID NO: 28207 - protein, 585 aa, Artificial Sequence
  hemagglutinin__InfluenzaB__AHM01184
MKAIIVLLMVVTSNADRICTGITSSNSPHVVKTATQGEVNVTGVITLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAEDAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28208 - protein, 585 aa, Artificial Sequence; identical to SEQ ID NO: 28203
  hemagglutinin__InfluenzaB__AHM01195

SEQ ID NO: 28209 - protein, 585 aa, Artificial Sequence
  hemagglutinin__InfluenzaB__AHM01206
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAEDAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSEKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLGNHTILLYYSTAASSLAVTLMIAIFVVYMVSRDNVSCSICL

SEQ ID NO: 28210 - protein, 585 aa, Artificial Sequence; identical to SEQ ID NO: 26872
  hemagglutinin__InfluenzaB__AHM01217

SEQ ID NO: 28211 - protein, 584 aa, Artificial Sequence; identical to SEQ ID NO: 26854
  hemagglutinin__InfluenzaB__AHM01228

SEQ ID NO: 28212 - protein, 585 aa, Artificial Sequence; identical to SEQ ID NO: 26887
  hemagglutinin__InfluenzaB__AHM01239

SEQ ID NO: 28213 - protein, 585 aa, Artificial Sequence; identical to SEQ ID NO: 26887
  hemagglutinin__InfluenzaB__AHM01250

SEQ ID NO: 28214 - protein, 585 aa, Artificial Sequence
  hemagglutinin__InfluenzaB__AHM01261
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITIWGFHSDNETQMAKLYGDSNPQKFTSSANGVTTHYVSQIGGFPNQTEDGGLPQSGRIVVDYMVQKSGKTGTITYQRGILLPQKVWCAGGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28215 - protein, 584 aa, Artificial Sequence; identical to SEQ ID NO: 26854
  hemagglutinin__InfluenzaB__AHM01272

SEQ ID NO: 28216 - protein, 585 aa, Artificial Sequence; identical to SEQ ID NO: 28203
  hemagglutinin__InfluenzaB__AHM01283

SEQ ID NO: 28217 - protein, 585 aa, Artificial Sequence; identical to SEQ ID NO: 28203
  hemagglutinin__InfluenzaB__AHM01294

SEQ ID NO: 28218 - protein, 584 aa, Artificial Sequence; identical to SEQ ID NO: 26854
  hemagglutinin__InfluenzaB__AHM01305

SEQ ID NO: 28219 - protein, 585 aa, Artificial Sequence; identical to SEQ ID NO: 26887
  hemagglutinin__InfluenzaB__AHM01316

SEQ ID NO: 28220 - protein, 585 aa, Artificial Sequence; identical to SEQ ID NO: 28203
  hemagglutinin__InfluenzaB__AHM01327

SEQ ID NO: 28221 - protein, 585 aa, Artificial Sequence; identical to SEQ ID NO: 26887
  hemagglutinin__InfluenzaB__AHM01338

SEQ ID NO: 28222 - protein, 585 aa, Artificial Sequence; identical to SEQ ID NO: 26887
  hemagglutinin__InfluenzaB__AHM01349

SEQ ID NO: 28223 - protein, 585 aa, Artificial Sequence
  hemagglutinin__InfluenzaB__AHM01360
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTKGEDQITVWGFHSDNETQMAKLYGDSNPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28224 - protein, 584 aa, Artificial Sequence
  hemagglutinin__InfluenzaB__AHM01371
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKNGFFATMAWAVPKDNNKNATNPLTVEVPYICAEGEDQIAVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28225 - protein, 584 aa, Artificial Sequence; identical to SEQ ID NO: 26854
  hemagglutinin__InfluenzaB__AHM01382

SEQ ID NO: 28226 - protein, 585 aa, Artificial Sequence
  hemagglutinin__InfluenzaB__AHM01393
MKAIIVLLMVVTSNADRICTGITSSNSPHIVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28227 - protein, 585 aa, Artificial Sequence; identical to SEQ ID NO: 26887
  hemagglutinin__InfluenzaB__AHM01404

SEQ ID NO: 28228 - protein, 585 aa, Artificial Sequence
  hemagglutinin__InfluenzaB__AHM01415
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAEDAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVIDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28229 - protein, 585 aa, Artificial Sequence
  hemagglutinin__InfluenzaB__AHM01426
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITIWGFHSDNETQMAKLYGDSNPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28230 - protein, 584 aa, Artificial Sequence
  hemagglutinin__InfluenzaB__AHM01437
MKAVIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEEEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28231 - protein, 584 aa, Artificial Sequence
  hemagglutinin__InfluenzaB__AHM01448
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTAEVPYICAEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28232 - protein, 585 aa, Artificial Sequence; identical to SEQ ID NO: 26645
  hemagglutinin__InfluenzaB__AHM01459

SEQ ID NO: 28233 - protein, 584 aa, Artificial Sequence
  hemagglutinin__InfluenzaB__AHM01470
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICTEGEDQIAVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAVNKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28234 - protein, 584 aa, Artificial Sequence
  hemagglutinin__InfluenzaB__AHM01481
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQIGGFPDQTEDGGLPQSGRIVVDYMMQKPGKTGTIVYQRGVLLPQRVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28235 - protein, 584 aa, Artificial Sequence; identical to SEQ ID NO: 26899
  hemagglutinin__InfluenzaB__AHM01492

SEQ ID NO: 28236 - protein, 584 aa, Artificial Sequence; identical to SEQ ID NO: 26854
  hemagglutinin__InfluenzaB__AHM01503

SEQ ID NO: 28237 - protein, 584 aa, Artificial Sequence; identical to SEQ ID NO: 26854
  hemagglutinin__InfluenzaB__AHM01514

SEQ ID NO: 28238 - protein, 584 aa, Artificial Sequence
  hemagglutinin__InfluenzaB__AHM01525
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQIGGFPDQTEDGGLPQSGRIVVDYMIQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28239 - protein, 584 aa, Artificial Sequence
  hemagglutinin__InfluenzaB__AHM01536
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGVHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28240 - protein, 584 aa, Artificial Sequence; identical to SEQ ID NO: 26854
  hemagglutinin__InfluenzaB__AHM01547

SEQ ID NO: 28241 - protein, 584 aa, Artificial Sequence; identical to SEQ ID NO: 26899
  hemagglutinin__InfluenzaB__AHM01558

SEQ ID NO: 28242 - protein, 585 aa, Artificial Sequence; identical to SEQ ID NO: 26740
  hemagglutinin__InfluenzaB__AHV83951

SEQ ID NO: 28243 - protein, 584 aa, Artificial Sequence; identical to SEQ ID NO: 28129
  hemagglutinin__InfluenzaB__AHV83952

SEQ ID NO: 28244 - protein, 585 aa, Artificial Sequence; identical to SEQ ID NO: 26683
  hemagglutinin__InfluenzaB__AHZ36697

SEQ ID NO: 28245 - protein, 585 aa, Artificial Sequence
  hemagglutinin__InfluenzaB__AHZ36708
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCLNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCTSGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28246 - protein, 585 aa, Artificial Sequence
  hemagglutinin__InfluenzaB__AHZ36719
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYVCTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28247 - protein, 585 aa, Artificial Sequence; identical to SEQ ID NO: 26683
  hemagglutinin__InfluenzaB__AHZ36730

SEQ ID NO: 28248 - protein, 585 aa, Artificial Sequence; identical to SEQ ID NO: 26683
  hemagglutinin__InfluenzaB__AHZ36752

SEQ ID NO: 28249 - protein, 585 aa, Artificial Sequence; identical to SEQ ID NO: 26645
  hemagglutinin__InfluenzaB__AHZ36763

SEQ ID NO: 28250 - protein, 585 aa, Artificial Sequence
  hemagglutinin__InfluenzaB__AHZ36774
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAESAPGGPYKIGTSGSCPNVTNGNGFFATMAWAVPKNDKNKTATDPLTIEVPYICTEEEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKVTKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28251 - protein, 585 aa, Artificial Sequence; identical to SEQ ID NO: 28159
  hemagglutinin__InfluenzaB__AHZ36785

SEQ ID NO: 28252 - protein, 585 aa, Artificial Sequence; identical to SEQ ID NO: 28159
  hemagglutinin__InfluenzaB__AHZ36796

SEQ ID NO: 28253 - protein, 584 aa, Artificial Sequence
  hemagglutinin__InfluenzaB__AHZ36807
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQIGGFPDQTEDGGLPQSGRIVVDYMMQKPEKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28254 - protein, 585 aa, Artificial Sequence; identical to SEQ ID NO: 26683
  hemagglutinin__InfluenzaB__AHZ36818

SEQ ID NO: 28255 - protein, 585 aa, Artificial Sequence; identical to SEQ ID NO: 26645
  hemagglutinin__InfluenzaB__AHZ36829

SEQ ID NO: 28256 - protein, 585 aa, Artificial Sequence; identical to SEQ ID NO: 26645
  hemagglutinin__InfluenzaB__AHZ36840

SEQ ID NO: 28257 - protein, 585 aa, Artificial Sequence; identical to SEQ ID NO: 28159
  hemagglutinin__InfluenzaB__AHZ36851

SEQ ID NO: 28258 - protein, 585 aa, Artificial Sequence; identical to SEQ ID NO: 26683
  hemagglutinin__InfluenzaB__AHZ36862

SEQ ID NO: 28259 - protein, 585 aa, Artificial Sequence; identical to SEQ ID NO: 26645
  hemagglutinin__InfluenzaB__AHZ36873

SEQ ID NO: 28260 - protein, 585 aa, Artificial Sequence
  hemagglutinin__InfluenzaB__AHZ36884
MKAIIVLLMVVTSNADRICTGITSSNSPHIVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFETMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28261 - protein, 585 aa, Artificial Sequence; identical to SEQ ID NO: 26683
  hemagglutinin__InfluenzaB__AHZ36895

SEQ ID NO: 28262 - protein, 585 aa, Artificial Sequence; identical to SEQ ID NO: 26683
  hemagglutinin__InfluenzaB__AHZ36906

SEQ ID NO: 28263 - protein, 585 aa, Artificial Sequence
  hemagglutinin__InfluenzaB__AHZ36928
MKAIIVLLMVVTSNADRICTGITSSNSPHVVKTATQGEVNVTGVIPLTTTPTKSHFANLKGTKTRGKLCPKCLNCTDLDVALGRPKCTGKIPSARVSILHEVRPVTSGCFPIMHDRTKIRQLPNLLRGYEHIRLSTHNVINAENAPGGPYKIGTSGSCLNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28264 - protein, 585 aa, Artificial Sequence; identical to SEQ ID NO: 28159
  hemagglutinin__InfluenzaB__AHZ36939

SEQ ID NO: 28265 - protein, 585 aa, Artificial Sequence
  hemagglutinin__InfluenzaB__AHZ36950
MKAIIVLLMVVTSNADRICTGITSSNSPHIVKTATQGEVNVTGVIPLTTTPTKSHFANLKGTETRGKLCPKCLNCTDLDVALGRPKCTGKIPSARVSILHEVRPITSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28266 - protein, 585 aa, Artificial Sequence
  hemagglutinin__InfluenzaB__AHZ36961
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGGSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28267 - protein, 585 aa, Artificial Sequence; identical to SEQ ID NO: 26683
  hemagglutinin__InfluenzaB__AHZ36972

SEQ ID NO: 28268 - protein, 585 aa, Artificial Sequence
  hemagglutinin__InfluenzaB__AHZ36983
MKAIIVLLMVVTSNADRICTGITSSNSPHIVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTAHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28269 - protein, 585 aa, Artificial Sequence
  hemagglutinin__InfluenzaB__AHZ37005
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAESAPGGPYKIGTSGSCPNVTNGNGFFATMAWAVPKNDKNKTATDPLTIEVPYICTEEEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28270 - protein, 585 aa, Artificial Sequence; identical to SEQ ID NO: 26645
  hemagglutinin__InfluenzaB__AHZ37016

SEQ ID NO: 28271 - protein, 585 aa, Artificial Sequence
  hemagglutinin__InfluenzaB__AHZ37027
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSIIHEVRPVTSGCFPIMHDRTKIRQLPNLLRGYEHIRLSTHNVINAENAPGGPYKIGTSGSCLNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28272 - protein, 585 aa, Artificial Sequence; identical to SEQ ID NO: 26645
  hemagglutinin__InfluenzaB__AHZ37038

SEQ ID NO: 28273 - protein, 585 aa, Artificial Sequence; identical to SEQ ID NO: 28159
  hemagglutinin__InfluenzaB__AHZ37049

SEQ ID NO: 28274 - protein, 585 aa, Artificial Sequence; identical to SEQ ID NO: 28159
  hemagglutinin__InfluenzaB__AHZ37060

SEQ ID NO: 28275 - protein, 585 aa, Artificial Sequence; identical to SEQ ID NO: 26645
  hemagglutinin__InfluenzaB__AHZ37071

SEQ ID NO: 28276 - protein, 585 aa, Artificial Sequence; identical to SEQ ID NO: 26645
  hemagglutinin__InfluenzaB__AHZ37082

SEQ ID NO: 28277 - protein, 585 aa, Artificial Sequence; identical to SEQ ID NO: 28159
  hemagglutinin__InfluenzaB__AHZ37093

SEQ ID NO: 28278 - protein, 585 aa, Artificial Sequence
  hemagglutinin__InfluenzaB__AHZ37104
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDHMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28279 - protein, 585 aa, Artificial Sequence
  hemagglutinin__InfluenzaB__AHZ41770
MKAIIVLLMVVTSNADRICTGITSSNSPHIVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTAINPLTIEVPYICTEGEDQITVWGFHSDNETQMAKLYGDSEPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28280 - protein, 585 aa, Artificial Sequence; identical to SEQ ID NO: 26683
  hemagglutinin__InfluenzaB__AHZ41781

SEQ ID NO: 28281 - protein, 585 aa, Artificial Sequence; identical to SEQ ID NO: 26683
  hemagglutinin__InfluenzaB__AHZ41792

SEQ ID NO: 28282 - protein, 585 aa, Artificial Sequence; identical to SEQ ID NO: 26683
  hemagglutinin__InfluenzaB__AHZ41803

SEQ ID NO: 28283 - protein, 585 aa, Artificial Sequence
  hemagglutinin__InfluenzaB__AHZ41814
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTVTYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28284 - protein, 585 aa, Artificial Sequence; identical to SEQ ID NO: 26683
  hemagglutinin__InfluenzaB__AHZ41825

SEQ ID NO: 28285 - protein, 585 aa, Artificial Sequence; identical to SEQ ID NO: 26683
  hemagglutinin__InfluenzaB__AHZ41836

SEQ ID NO: 28286 - protein, 585 aa, Artificial Sequence; identical to SEQ ID NO: 26683
  hemagglutinin__InfluenzaB__AHZ41847

SEQ ID NO: 28287 - protein, 584 aa, Artificial Sequence; identical to SEQ ID NO: 28131
  hemagglutinin__InfluenzaB__AHZ41858

SEQ ID NO: 28288 - protein, 585 aa, Artificial Sequence; identical to SEQ ID NO: 28156
  hemagglutinin__InfluenzaB__AHZ41869

SEQ ID NO: 28289 - protein, 584 aa, Artificial Sequence
  hemagglutinin__InfluenzaB__AIC73844
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28290 - protein, 585 aa, Artificial Sequence; identical to SEQ ID NO: 27865
  hemagglutinin__InfluenzaB__AIC73845

SEQ ID NO: 28291 - protein, 585 aa, Artificial Sequence; identical to SEQ ID NO: 27865
  hemagglutinin__InfluenzaB__AIC73846

SEQ ID NO: 28292 - protein, 585 aa, Artificial Sequence
  hemagglutinin__InfluenzaB__AIC73847
MKAIIVLLMVVTSNADRICTGITSSNSPHVVKTATQGEVNVTGVIPLTTTPTKSHFANLKGTETRGKLCPKCLDCTDLDVALGRPKCTGKIPSARVSILHEVRPVTSGCFPIMHDRTKIRQLPNLLRGYEHIRLSTHNVINAEDAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28293 - protein, 585 aa, Artificial Sequence; identical to SEQ ID NO: 27865
  hemagglutinin__InfluenzaB__AIC73848

SEQ ID NO: 28294 - protein, 584 aa, Artificial Sequence; identical to SEQ ID NO: 28129
  hemagglutinin__InfluenzaB__AIC73849

SEQ ID NO: 28295 - protein, 585 aa, Artificial Sequence
  hemagglutinin__InfluenzaB__AIC73850
MKAIIVLLMVATSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAEDAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28296 - protein, 585 aa, Artificial Sequence; identical to SEQ ID NO: 26887
  hemagglutinin__InfluenzaB__AIC73851

SEQ ID NO: 28297 - protein, 584 aa, Artificial Sequence; identical to SEQ ID NO: 28289
  hemagglutinin__InfluenzaB__AIC73852

SEQ ID NO: 28298 - protein, 584 aa, Artificial Sequence; identical to SEQ ID NO: 28289
  hemagglutinin__InfluenzaB__AIC73853

SEQ ID NO: 28299 - protein, 585 aa, Artificial Sequence
  hemagglutinin__InfluenzaB__AIC73855
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYIIGTSGSCPNVTNGNGFFATMAWAVPKNDKNKTATNPLTIEVPYICTEGEDQITVWGFHSDNETQMAKLYGDSNPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28300 - protein, 585 aa, Artificial Sequence; identical to SEQ ID NO: 27865
  hemagglutinin__InfluenzaB__AIC73856

SEQ ID NO: 28301 - protein, 585 aa, Artificial Sequence; identical to SEQ ID NO: 27865
  hemagglutinin__InfluenzaB__AIC73857

SEQ ID NO: 28302 - protein, 585 aa, Artificial Sequence; identical to SEQ ID NO: 27865
  hemagglutinin__InfluenzaB__AIC73859

SEQ ID NO: 28303 - protein, 585 aa, Artificial Sequence
  hemagglutinin__InfluenzaB__AIC73860
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSNPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTMSSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28304 - protein, 585 aa, Artificial Sequence
  hemagglutinin__InfluenzaB__AIC73861
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINTENAPGGPYKIGTSGSCPNVTNGNGFFATMAWAVPKNDKNKTATNPLTIEVPYICTEGEDQITVWGFHSDNETQMAKLYGDSNPQKFTSSANGVTIHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28305 - protein, 585 aa, Artificial Sequence; identical to SEQ ID NO: 28303
  hemagglutinin__InfluenzaB__AIC73862

SEQ ID NO: 28306 - protein, 585 aa, Artificial Sequence; identical to SEQ ID NO: 28303
  hemagglutinin__InfluenzaB__AIC73863

SEQ ID NO: 28307 - protein, 585 aa, Artificial Sequence; identical to SEQ ID NO: 28303
  hemagglutinin__InfluenzaB__AIC73864

SEQ ID NO: 28308 - protein, 584 aa, Artificial Sequence
  hemagglutinin__InfluenzaB__AIC73865
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQIGGFPDQREDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28309 - protein, 585 aa, Artificial Sequence
  hemagglutinin__InfluenzaB__AIC73867
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVIDAENAPGGPYKIGTSGSCPNVTNGNGFFATMAWAVPKNDKNKTATNPLTIEVPYICTEGEDQITVWGFHSDNETQMAKLYGDSNPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28310 - protein, 585 aa, Artificial Sequence; identical to SEQ ID NO: 26887
  hemagglutinin__InfluenzaB__AIC73868

SEQ ID NO: 28311 - protein, 585 aa, Artificial Sequence; identical to SEQ ID NO: 28303
  hemagglutinin__InfluenzaB__AIC73869

SEQ ID NO: 28312 - protein, 585 aa, Artificial Sequence; identical to SEQ ID NO: 28303
  hemagglutinin__InfluenzaB__AIC73870

SEQ ID NO: 28313 - protein, 585 aa, Artificial Sequence; identical to SEQ ID NO: 27865
  hemagglutinin__InfluenzaB__AIC73871

SEQ ID NO: 28314 - protein, 584 aa, Artificial Sequence; identical to SEQ ID NO: 28289
  hemagglutinin__InfluenzaB__AIC73872

SEQ ID NO: 28315 - protein, 584 aa, Artificial Sequence; identical to SEQ ID NO: 28129
  hemagglutinin__InfluenzaB__AIC73873

SEQ ID NO: 28316 - protein, 584 aa, Artificial Sequence; identical to SEQ ID NO: 28289
  hemagglutinin__InfluenzaB__AIC73874

SEQ ID NO: 28317 - protein, 584 aa, Artificial Sequence; identical to SEQ ID NO: 28308
  hemagglutinin__InfluenzaB__AIC73875

SEQ ID NO: 28318 - protein, 584 aa, Artificial Sequence
  hemagglutinin__InfluenzaB__AIC73876
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQITVWGFHSDNKTQMKNLYGDSNPQKFTSSANGVTTHYVSQIGGFPDQREDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLNRIAAGTFNAGEFSLPTFDSLNITAASLNDDGLDNHTILLYYSTAASSLAVTLMLAIFIVYMVSRDNVSCSICL

SEQ ID NO: 28319 - protein, 584 aa, Artificial Sequence; identical to SEQ ID NO: 28308
  hemagglutinin__InfluenzaB__AIC73877

SEQ ID NO: 28320 - protein, 584 aa, Artificial Sequence; identical to SEQ ID NO: 28308
  hemagglutinin__InfluenzaB__AIC73878

SEQ ID NO: 28321 - protein, 584 aa, Artificial Sequence; identical to SEQ ID NO: 28308
  hemagglutinin__InfluenzaB__AIC73879

SEQ ID NO: 28322 - protein, 584 aa, Artificial Sequence; identical to SEQ ID NO: 28308
  hemagglutinin__InfluenzaB__AIC73880

SEQ ID NO: 28323 - protein, 584 aa, Artificial Sequence; identical to SEQ ID NO: 28308
  hemagglutinin__InfluenzaB__AIC73881

SEQ ID NO: 28324 - protein, 584 aa, Artificial Sequence; identical to SEQ ID NO: 28308
  hemagglutinin__InfluenzaB__AIC73882

SEQ ID NO: 28325 - protein, 584 aa, Artificial Sequence; identical to SEQ ID NO: 28129
  hemagglutinin__InfluenzaB__AIC73883

SEQ ID NO: 28326 - protein, 584 aa, Artificial Sequence; identical to SEQ ID NO: 28308
  hemagglutinin__InfluenzaB__AIC73884

SEQ ID NO: 28327 - protein, 585 aa, Artificial Sequence
  hemagglutinin__InfluenzaB__AIC73885
MEAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAEDAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28328 - protein, 585 aa, Artificial Sequence; identical to SEQ ID NO: 27865
  hemagglutinin__InfluenzaB__AIC73886

SEQ ID NO: 28329 - protein, 585 aa, Artificial Sequence; identical to SEQ ID NO: 28309
  hemagglutinin__InfluenzaB__AIC73887

SEQ ID NO: 28330 - protein, 584 aa, Artificial Sequence; identical to SEQ ID NO: 28129
  hemagglutinin__InfluenzaB__AIC73888

SEQ ID NO: 28331 - protein, 584 aa, Artificial Sequence; identical to SEQ ID NO: 28289
  hemagglutinin__InfluenzaB__AIC73889

SEQ ID NO: 28332 - protein, 584 aa, Artificial Sequence; identical to SEQ ID NO: 28289
  hemagglutinin__InfluenzaB__AIC73890

SEQ ID NO: 28333 - protein, 585 aa, Artificial Sequence
  hemagglutinin__InfluenzaB__AIC73892
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAEDAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTSLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28334 - protein, 584 aa, Artificial Sequence; identical to SEQ ID NO: 28129
  hemagglutinin__InfluenzaB__AIC73893

SEQ ID NO: 28335 - protein, 584 aa, Artificial Sequence; identical to SEQ ID NO: 28289
  hemagglutinin__InfluenzaB__AIC73894

SEQ ID NO: 28336 - protein, 584 aa, Artificial Sequence; identical to SEQ ID NO: 28289
  hemagglutinin__InfluenzaB__AIC73895

SEQ ID NO: 28337 - protein, 584 aa, Artificial Sequence; identical to SEQ ID NO: 28289
  hemagglutinin__InfluenzaB__AIC73896

SEQ ID NO: 28338 - protein, 584 aa, Artificial Sequence; identical to SEQ ID NO: 28289
  hemagglutinin__InfluenzaB__AIC73897

SEQ ID NO: 28339 - protein, 584 aa, Artificial Sequence; identical to SEQ ID NO: 28289
  hemagglutinin__InfluenzaB__AIC73898

SEQ ID NO: 28340 - protein, 584 aa, Artificial Sequence; identical to SEQ ID NO: 28289
  hemagglutinin__InfluenzaB__AIC73899

SEQ ID NO: 28341 - protein, 584 aa, Artificial Sequence; identical to SEQ ID NO: 28289
  hemagglutinin__InfluenzaB__AIC73900

SEQ ID NO: 28342 - protein, 584 aa, Artificial Sequence; identical to SEQ ID NO: 28289
  hemagglutinin__InfluenzaB__AIC73902

SEQ ID NO: 28343 - protein, 584 aa, Artificial Sequence
  hemagglutinin__InfluenzaB__AIC73903
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSANGITTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28344 - protein, 584 aa, Artificial Sequence
  hemagglutinin__InfluenzaB__AIC73904
MKAIIVLLMVVTSNADRICTGITSSNSPHVVKTATQGEVNVTGVIPLTTTPTKSYFANLKGTRTRGKLCPDCLNCTDLDVALGRPMCVGITPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28345 - protein, 584 aa, Artificial Sequence; identical to SEQ ID NO: 28289
  hemagglutinin__InfluenzaB__AIC73905

SEQ ID NO: 28346 - protein, 584 aa, Artificial Sequence; identical to SEQ ID NO: 28289
  hemagglutinin__InfluenzaB__AIC73906

SEQ ID NO: 28347 - protein, 584 aa, Artificial Sequence; identical to SEQ ID NO: 28289
  hemagglutinin__InfluenzaB__AIC73907

SEQ ID NO: 28348 - protein, 584 aa, Artificial Sequence; identical to SEQ ID NO: 28289
  hemagglutinin__InfluenzaB__AIC73908

SEQ ID NO: 28349 - protein, 584 aa, Artificial Sequence; identical to SEQ ID NO: 28289
  hemagglutinin__InfluenzaB__AIC73909

SEQ ID NO: 28350 - protein, 584 aa, Artificial Sequence; identical to SEQ ID NO: 28289
  hemagglutinin__InfluenzaB__AIC73910

SEQ ID NO: 28351 - protein, 584 aa, Artificial Sequence; identical to SEQ ID NO: 28289
  hemagglutinin__InfluenzaB__AIC73911

SEQ ID NO: 28352 - protein, 584 aa, Artificial Sequence; identical to SEQ ID NO: 28289
  hemagglutinin__InfluenzaB__AIC73912

SEQ ID NO: 28353 - protein, 584 aa, Artificial Sequence; identical to SEQ ID NO: 28289
  hemagglutinin__InfluenzaB__AIC73913

SEQ ID NO: 28354 - protein, 584 aa, Artificial Sequence; identical to SEQ ID NO: 28289
  hemagglutinin__InfluenzaB__AIC73914

SEQ ID NO: 28355 - protein, 584 aa, Artificial Sequence; identical to SEQ ID NO: 28289
  hemagglutinin__InfluenzaB__AIC73915

SEQ ID NO: 28356 - protein, 584 aa, Artificial Sequence; identical to SEQ ID NO: 28289
  hemagglutinin__InfluenzaB__AIC73916

SEQ ID NO: 28357 - protein, 584 aa, Artificial Sequence; identical to SEQ ID NO: 28289
  hemagglutinin__InfluenzaB__AIC73917

SEQ ID NO: 28358 - protein, 584 aa, Artificial Sequence; identical to SEQ ID NO: 28289
  hemagglutinin__InfluenzaB__AIC73918

SEQ ID NO: 28359 - protein, 584 aa, Artificial Sequence; identical to SEQ ID NO: 28129
  hemagglutinin__InfluenzaB__AIC73919

SEQ ID NO: 28360 - protein, 584 aa, Artificial Sequence; identical to SEQ ID NO: 28289
  hemagglutinin__InfluenzaB__AIC73920

SEQ ID NO: 28361 - protein, 585 aa, Artificial Sequence; identical to SEQ ID NO: 27865
  hemagglutinin__InfluenzaB__AIC73921

SEQ ID NO: 28362 - protein, 584 aa, Artificial Sequence; identical to SEQ ID NO: 28289
  hemagglutinin__InfluenzaB__AIC73922

SEQ ID NO: 28363 - protein, 585 aa, Artificial Sequence; identical to SEQ ID NO: 26887
  hemagglutinin__InfluenzaB__AIC73924

SEQ ID NO: 28364 - protein, 585 aa, Artificial Sequence
  hemagglutinin__InfluenzaB__AIC73925
MKATIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAEDAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28365 - protein, 584 aa, Artificial Sequence; identical to SEQ ID NO: 28289
  hemagglutinin__InfluenzaB__AIC73926

SEQ ID NO: 28366 - protein, 584 aa, Artificial Sequence; identical to SEQ ID NO: 26567
  hemagglutinin__InfluenzaB__AIL94977

SEQ ID NO: 28367 - protein, 584 aa, Artificial Sequence; identical to SEQ ID NO: 26567
  hemagglutinin__InfluenzaB__AIL94988

SEQ ID NO: 28368 - protein, 584 aa, Artificial Sequence
  hemagglutinin__InfluenzaB__AIL94999
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKTGFFATMAWAVPKDNYKNATNPLTVEVPYICTEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28369 - protein, 584 aa, Artificial Sequence; identical to SEQ ID NO: 26567
  hemagglutinin__InfluenzaB__AIL95010

SEQ ID NO: 28370 - protein, 584 aa, Artificial Sequence; identical to SEQ ID NO: 26820
  hemagglutinin__InfluenzaB__AIL95021

SEQ ID NO: 28371 - protein, 585 aa, Artificial Sequence; identical to SEQ ID NO: 26648
  hemagglutinin__InfluenzaB__AIL95032

SEQ ID NO: 28372 - protein, 584 aa, Artificial Sequence; identical to SEQ ID NO: 26820
  hemagglutinin__InfluenzaB__AIL95043

SEQ ID NO: 28373 - protein, 585 aa, Artificial Sequence; identical to SEQ ID NO: 26694
  hemagglutinin__InfluenzaB__AIL95054

SEQ ID NO: 28374 - protein, 585 aa, Artificial Sequence; identical to SEQ ID NO: 26648
  hemagglutinin__InfluenzaB__AIL95065

SEQ ID NO: 28375 - protein, 585 aa, Artificial Sequence; identical to SEQ ID NO: 26645
  hemagglutinin__InfluenzaB__AIL95076

SEQ ID NO: 28376 - protein, 585 aa, Artificial Sequence; identical to SEQ ID NO: 26648
  hemagglutinin__InfluenzaB__AIL95087

SEQ ID NO: 28377 - protein, 584 aa, Artificial Sequence; identical to SEQ ID NO: 26820
  hemagglutinin__InfluenzaB__AIL95098

SEQ ID NO: 28378 - protein, 585 aa, Artificial Sequence; identical to SEQ ID NO: 28159
  hemagglutinin__InfluenzaB__AIL95109

SEQ ID NO: 28379 - protein, 585 aa, Artificial Sequence
  hemagglutinin__InfluenzaB__AIL95120
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDKIAAGTFDAGEFSLPTFDSLNITAASLNDDGLDNHTILLYYSTAASSLAVTLMIAIFVVYMVSRDNVSCSICL

SEQ ID NO: 28380 - protein, 584 aa, Artificial Sequence; identical to SEQ ID NO: 28289
  hemagglutinin__InfluenzaB__AKA54644

SEQ ID NO: 28381 - protein, 584 aa, Artificial Sequence
  hemagglutinin__InfluenzaB__AKA54645
MKAITVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSADGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28382 - protein, 584 aa, Artificial Sequence; identical to SEQ ID NO: 28289
  hemagglutinin__InfluenzaB__AKA54646

SEQ ID NO: 28383 - protein, 584 aa, Artificial Sequence; identical to SEQ ID NO: 28289
  hemagglutinin__InfluenzaB__AKA54647

SEQ ID NO: 28384 - protein, 585 aa, Artificial Sequence; identical to SEQ ID NO: 26887
  hemagglutinin__InfluenzaB__AKA54648

SEQ ID NO: 28385 - protein, 584 aa, Artificial Sequence
  hemagglutinin__InfluenzaB__AKA54649
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNTTSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28386 - protein, 584 aa, Artificial Sequence; identical to SEQ ID NO: 28289
  hemagglutinin__InfluenzaB__AKU40581

SEQ ID NO: 28387 - protein, 584 aa, Artificial Sequence; identical to SEQ ID NO: 28289
  hemagglutinin__InfluenzaB__AKU40592

SEQ ID NO: 28388 - protein, 584 aa, Artificial Sequence; identical to SEQ ID NO: 28129
  hemagglutinin__InfluenzaB__AKU40603

SEQ ID NO: 28389 - protein, 584 aa, Artificial Sequence; identical to SEQ ID NO: 28289
  hemagglutinin__InfluenzaB__AKU40614

SEQ ID NO: 28390 - protein, 584 aa, Artificial Sequence; identical to SEQ ID NO: 28129
  hemagglutinin__InfluenzaB__AKU40625

SEQ ID NO: 28391 - protein, 584 aa, Artificial Sequence
  hemagglutinin__InfluenzaB__AKU40636
MKAIIVLLMVVTSNADRICTGITSSNSPHVVKTATQGEVNVTGVIPLTTTPAKSYFANLKGTRTRGKLCPDCLNCTDLDVALGRPMCVGTTPSAKASILHEVRPVTSGCFPIMHDRTKIRQLPNLLRGYENIRLSTKNVIDAEKAPGGPYRLGTSGSCPNATSKIGFFATMAWAVPKDNYKNATNPLTVEVPYICKEGEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28392 - protein, 584 aa, Artificial Sequence
  hemagglutinin__InfluenzaB__AKU40647
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEIPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28393 - protein, 584 aa, Artificial Sequence; identical to SEQ ID NO: 28289
  hemagglutinin__InfluenzaB__AKU40658

SEQ ID NO: 28394 - protein, 584 aa, Artificial Sequence; identical to SEQ ID NO: 28289
  hemagglutinin__InfluenzaB__AKU40669

SEQ ID NO: 28395 - protein, 584 aa, Artificial Sequence; identical to SEQ ID NO: 28289
  hemagglutinin__InfluenzaB__AKU40680

SEQ ID NO: 28396 - protein, 584 aa, Artificial Sequence
  hemagglutinin__InfluenzaB__AKU40691
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDEFHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28397 - protein, 584 aa, Artificial Sequence; identical to SEQ ID NO: 28289
  hemagglutinin__InfluenzaB__AKU40702

SEQ ID NO: 28398 - protein, 584 aa, Artificial Sequence; identical to SEQ ID NO: 28289
  hemagglutinin__InfluenzaB__AKU40713

SEQ ID NO: 28399 - protein, 584 aa, Artificial Sequence; identical to SEQ ID NO: 28129
  hemagglutinin__InfluenzaB__AKU40724

SEQ ID NO: 28400 - protein, 584 aa, Artificial Sequence; identical to SEQ ID NO: 28392
  hemagglutinin__InfluenzaB__AKU40735

SEQ ID NO: 28401 - protein, 584 aa, Artificial Sequence; identical to SEQ ID NO: 28289
  hemagglutinin__InfluenzaB__AKU40746

SEQ ID NO: 28402 - protein, 584 aa, Artificial Sequence; identical to SEQ ID NO: 28289
  hemagglutinin__InfluenzaB__AKU40757

SEQ ID NO: 28403 - protein, 584 aa, Artificial Sequence; identical to SEQ ID NO: 28289
  hemagglutinin__InfluenzaB__AKU40768

SEQ ID NO: 28404 - protein, 584 aa, Artificial Sequence; identical to SEQ ID NO: 28289
  hemagglutinin__InfluenzaB__AKU40779

SEQ ID NO: 28405 - protein, 584 aa, Artificial Sequence; identical to SEQ ID NO: 28129
  hemagglutinin__InfluenzaB__AKU40790

SEQ ID NO: 28406 - protein, 584 aa, Artificial Sequence; identical to SEQ ID NO: 28289
  hemagglutinin__InfluenzaB__AKU40801

SEQ ID NO: 28407 - protein, 584 aa, Artificial Sequence
  hemagglutinin__InfluenzaB__AKU40812
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDSHTILLYYSTAASSLAVTLMLAIFIVYMVSRDNVSCSICL

SEQ ID NO: 28408 - protein, 584 aa, Artificial Sequence; identical to SEQ ID NO: 28289
  hemagglutinin__InfluenzaB__AKU40823

SEQ ID NO: 28409 - protein, 584 aa, Artificial Sequence; identical to SEQ ID NO: 28289
  hemagglutinin__InfluenzaB__AKU40834

SEQ ID NO: 28410 - protein, 584 aa, Artificial Sequence; identical to SEQ ID NO: 28289
  hemagglutinin__InfluenzaB__AKU40845

SEQ ID NO: 28411 - protein, 584 aa, Artificial Sequence; identical to SEQ ID NO: 28289
  hemagglutinin__InfluenzaB__AKU40856

SEQ ID NO: 28412 - protein, 584 aa, Artificial Sequence; identical to SEQ ID NO: 28289
  hemagglutinin__InfluenzaB__AKU40867

SEQ ID NO: 28413 - protein, 584 aa, Artificial Sequence; identical to SEQ ID NO: 28289
  hemagglutinin__InfluenzaB__AKU40878

SEQ ID NO: 28414 - protein, 585 aa, Artificial Sequence
  hemagglutinin__InfluenzaB__AKU40889
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAEDAPGGPYKIGTSGSCPNVTNGNGFFATMAWAVPKNDKNKTATNPLTTEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28415 - protein, 584 aa, Artificial Sequence; identical to SEQ ID NO: 28289
  hemagglutinin__InfluenzaB__AKU40900

SEQ ID NO: 28416 - protein, 584 aa, Artificial Sequence; identical to SEQ ID NO: 28129
  hemagglutinin__InfluenzaB__AKU40911

SEQ ID NO: 28417 - protein, 584 aa, Artificial Sequence
  hemagglutinin__InfluenzaB__AKU40922
MKAIIVLLMVVTSNADRICTGITSSNSPHVVKTVTQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28418 - protein, 584 aa, Artificial Sequence; identical to SEQ ID NO: 28392
  hemagglutinin__InfluenzaB__AKU40933

SEQ ID NO: 28419 - protein, 584 aa, Artificial Sequence; identical to SEQ ID NO: 28289
  hemagglutinin__InfluenzaB__AKU40944

SEQ ID NO: 28420 - protein, 584 aa, Artificial Sequence; identical to SEQ ID NO: 28289
  hemagglutinin__InfluenzaB__AKU40955

SEQ ID NO: 28421 - protein, 584 aa, Artificial Sequence; identical to SEQ ID NO: 28289
  hemagglutinin__InfluenzaB__AKU40966

SEQ ID NO: 28422 - protein, 584 aa, Artificial Sequence; identical to SEQ ID NO: 28289
  hemagglutinin__InfluenzaB__AKU40977

SEQ ID NO: 28423 - protein, 584 aa, Artificial Sequence; identical to SEQ ID NO: 28289
  hemagglutinin__InfluenzaB__AKU40987

SEQ ID NO: 28424 - protein, 584 aa, Artificial Sequence; identical to SEQ ID NO: 28289
  hemagglutinin__InfluenzaB__AKU40998

SEQ ID NO: 28425 - protein, 584 aa, Artificial Sequence; identical to SEQ ID NO: 28289
  hemagglutinin__InfluenzaB__AKU41009

SEQ ID NO: 28426 - protein, 584 aa, Artificial Sequence; identical to SEQ ID NO: 28289
  hemagglutinin__InfluenzaB__AKU41020

SEQ ID NO: 28427 - protein, 584 aa, Artificial Sequence; identical to SEQ ID NO: 28289
  hemagglutinin__InfluenzaB__ALA08485

SEQ ID NO: 28428 - protein, 584 aa, Artificial Sequence; identical to SEQ ID NO: 28289
  hemagglutinin__InfluenzaB__ALA08486

SEQ ID NO: 28429 - protein, 584 aa, Artificial Sequence; identical to SEQ ID NO: 28289
  hemagglutinin__InfluenzaB__ALA08487

SEQ ID NO: 28430 - protein, 584 aa, Artificial Sequence; identical to SEQ ID NO: 28289
  hemagglutinin__InfluenzaB__ALA08564

SEQ ID NO: 28431 - protein, 584 aa, Artificial Sequence; identical to SEQ ID NO: 28289
  hemagglutinin__InfluenzaB__ALA08565

SEQ ID NO: 28432 - protein, 584 aa, Artificial Sequence; identical to SEQ ID NO: 28289
  hemagglutinin__InfluenzaB__ALA08566

SEQ ID NO: 28433 - protein, 584 aa, Artificial Sequence; identical to SEQ ID NO: 28289
  hemagglutinin__InfluenzaB__ALA08567

SEQ ID NO: 28434 - protein, 584 aa, Artificial Sequence; identical to SEQ ID NO: 28289
  hemagglutinin__InfluenzaB__ALA08568

SEQ ID NO: 28435 - protein, 584 aa, Artificial Sequence; identical to SEQ ID NO: 28289
  hemagglutinin__InfluenzaB__ALA08569

SEQ ID NO: 28436 - protein, 585 aa, Artificial Sequence
  hemagglutinin__InfluenzaB__ALA08689
MKAIIVLLMVVTSNADRICTGITSSNSPHVVKTATQGEVNVTGVIPLTTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSNPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28437 - protein, 585 aa, Artificial Sequence
  hemagglutinin__InfluenzaB__ALA08690
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAEDAPGGPYKIGTSGSCPNITNGNGFFATMAWAVQKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDDHTILLYYSTAASSLAVTLMIAIFVVYMVSRDNVSCSICL

SEQ ID NO: 28438 - protein, 584 aa, Artificial Sequence; identical to SEQ ID NO: 28289
  hemagglutinin__InfluenzaB__ALE31766

SEQ ID NO: 28439 - protein, 585 aa, Artificial Sequence
  hemagglutinin__InfluenzaB__ALE31768
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAEDAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28440 - protein, 585 aa, Artificial Sequence
  hemagglutinin__InfluenzaB__ALE31770
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHISLSTHNVINAEDAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28441 - protein, 584 aa, Artificial Sequence; identical to SEQ ID NO: 28289
  hemagglutinin__InfluenzaB__ALE31772

SEQ ID NO: 28442 - protein, 584 aa, Artificial Sequence; identical to SEQ ID NO: 28289
  hemagglutinin__InfluenzaB__ALE31773

SEQ ID NO: 28443 - protein, 584 aa, Artificial Sequence
  hemagglutinin__InfluenzaB__ALE31884
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSVCL

SEQ ID NO: 28444 - protein, 584 aa, Artificial Sequence
  hemagglutinin__InfluenzaB__ALE31885
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFVVYMVSRDNVSCSICL

SEQ ID NO: 28445 - protein, 584 aa, Artificial Sequence; identical to SEQ ID NO: 28289
  hemagglutinin__InfluenzaB__ALE31886

SEQ ID NO: 28446 - protein, 584 aa, Artificial Sequence
  hemagglutinin__InfluenzaB__ALE31887
MKAIIVLLMVVTSNADRICTGITSSNSPHVVKTATQGEINVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28447 - protein, 584 aa, Artificial Sequence; identical to SEQ ID NO: 28289
  hemagglutinin__InfluenzaB__ALE31982

SEQ ID NO: 28448 - protein, 584 aa, Artificial Sequence
  hemagglutinin__InfluenzaB__ALE31983
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLALFIVYMVSRDNVSCSICL

SEQ ID NO: 28449 - protein, 584 aa, Artificial Sequence
  hemagglutinin__InfluenzaB__ALE31984
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEEEDQITVWGFHSDNKTQMKSLYGDSNPQKFTSSANGVTTHYVSQIGDFPDQTEDGGLPQSGRIVVDYMVQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28450 - protein, 584 aa, Artificial Sequence; identical to SEQ ID NO: 28289
  hemagglutinin__InfluenzaB__ALE31985

SEQ ID NO: 28451 - protein, 585 aa, Artificial Sequence
  hemagglutinin__InfluenzaB__ALE31986
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAEDAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVIDYMVQKSGKTGTITYQRGILLPQKVWCASGRSKVIKGSLPLIGEADCLHEKYGGLNKSKPYYTGEHAKAVGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28452 - protein, 584 aa, Artificial Sequence
  hemagglutinin__InfluenzaB__ALE31988
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSANGVTTHYVSQIGDFPDQTEDGGLPQSGRIVVDYMVQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28453 - protein, 585 aa, Artificial Sequence; identical to SEQ ID NO: 28451
  hemagglutinin__InfluenzaB__ALE31989

SEQ ID NO: 28454 - protein, 585 aa, Artificial Sequence; identical to SEQ ID NO: 28451
  hemagglutinin__InfluenzaB__ALE31990

SEQ ID NO: 28455 - protein, 584 aa, Artificial Sequence; identical to SEQ ID NO: 28289
  hemagglutinin__InfluenzaB__ALE31991

SEQ ID NO: 28456 - protein, 585 aa, Artificial Sequence
  hemagglutinin__InfluenzaB__ALE31992
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHVRLSTHNVINAEDAPGGPYKIGTSGSCPNITNGNGFFATMAWAVPKNDKNKTATNPLTIEVPYICTEREDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28457 - protein, 585 aa, Artificial Sequence; identical to SEQ ID NO: 27865
  hemagglutinin__InfluenzaB__ALE31993

SEQ ID NO: 28458 - protein, 585 aa, Artificial Sequence
  hemagglutinin__InfluenzaB__ALE31994
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHVRLSTHNVINAEDAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVRTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28459 - protein, 584 aa, Artificial Sequence; identical to SEQ ID NO: 28448
  hemagglutinin__InfluenzaB__ALN39719

SEQ ID NO: 28460 - protein, 584 aa, Artificial Sequence; identical to SEQ ID NO: 28289
  hemagglutinin__InfluenzaB__ALN39720

SEQ ID NO: 28461 - protein, 584 aa, Artificial Sequence; identical to SEQ ID NO: 28289
  hemagglutinin__InfluenzaB__ALN39721

SEQ ID NO: 28462 - protein, 584 aa, Artificial Sequence; identical to SEQ ID NO: 28289
  hemagglutinin__InfluenzaB__ALN39723

SEQ ID NO: 28463 - protein, 584 aa, Artificial Sequence; identical to SEQ ID NO: 28289
  hemagglutinin__InfluenzaB__ALN39724

SEQ ID NO: 28464 - protein, 584 aa, Artificial Sequence; identical to SEQ ID NO: 28452
  hemagglutinin__InfluenzaB__ALN39725

SEQ ID NO: 28465 - protein, 584 aa, Artificial Sequence
  hemagglutinin__InfluenzaB__ALN39726
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSADGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28466 - protein, 584 aa, Artificial Sequence; identical to SEQ ID NO: 28452
  hemagglutinin__InfluenzaB__ALN39727

SEQ ID NO: 28467 - protein, 584 aa, Artificial Sequence; identical to SEQ ID NO: 28289
  hemagglutinin__InfluenzaB__ALN39728

SEQ ID NO: 28468 - protein, 584 aa, Artificial Sequence; identical to SEQ ID NO: 28289
  hemagglutinin__InfluenzaB__ALN39729

SEQ ID NO: 28469 - protein, 585 aa, Artificial Sequence
  hemagglutinin__InfluenzaB__ALN39730
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHVRLSTHNVINAEDAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFFLPTFDSLNITAASLNDDGLDNHTILLYYSTAASSLAVTLMIAIFVVYMVSRDNVSCSICL

SEQ ID NO: 28470 - protein, 584 aa, Artificial Sequence; identical to SEQ ID NO: 28289
  hemagglutinin__InfluenzaB__ALN39732

SEQ ID NO: 28471 - protein, 584 aa, Artificial Sequence
  hemagglutinin__InfluenzaB__ALN39733
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHRCNQTCLDRIAAGTFNAGEFSLPTFDSLNITAASLNDDGLDNHTILLYYSTAASSLAVTLMLAIFIVYMVSRDNVSCSICL

SEQ ID NO: 28472 - protein, 584 aa, Artificial Sequence
  hemagglutinin__InfluenzaB__ALN39751
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMVAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLALFIVYMVSRDNVSCSICL

SEQ ID NO: 28473 - protein, 584 aa, Artificial Sequence; identical to SEQ ID NO: 28448
  hemagglutinin__InfluenzaB__ALN39752

SEQ ID NO: 28474 - protein, 584 aa, Artificial Sequence; identical to SEQ ID NO: 28289
  hemagglutinin__InfluenzaB__ALN39753

SEQ ID NO: 28475 - protein, 585 aa, Artificial Sequence
  hemagglutinin__InfluenzaB__ALN39754
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHVRLSTHNVINAEDAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28476 - protein, 585 aa, Artificial Sequence
  hemagglutinin__InfluenzaB__ALN39755
MKAIIVLLLVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHVRLSTHNVINAEDAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28477 - protein, 584 aa, Artificial Sequence
  hemagglutinin__InfluenzaB__ALN39756
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNVGEFSLPTFDSLNITAASLNDDGLDNHTILLYYSTAASSLAVTLMLAIFIVYMVSRDNVSCSICL

SEQ ID NO: 28478 - protein, 585 aa, Artificial Sequence; identical to SEQ ID NO: 28475
  hemagglutinin__InfluenzaB__ALN39757

SEQ ID NO: 28479 - protein, 584 aa, Artificial Sequence; identical to SEQ ID NO: 28289
  hemagglutinin__InfluenzaB__ALN39758

SEQ ID NO: 28480 - protein, 584 aa, Artificial Sequence
  hemagglutinin__InfluenzaB__ALN39759
MKTIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28481 - protein, 585 aa, Artificial Sequence; identical to SEQ ID NO: 28439
  hemagglutinin__InfluenzaB__ALN39760

SEQ ID NO: 28482 - protein, 584 aa, Artificial Sequence; identical to SEQ ID NO: 28289
  hemagglutinin__InfluenzaB__ALN39761

SEQ ID NO: 28483 - protein, 584 aa, Artificial Sequence; identical to SEQ ID NO: 28289
  hemagglutinin__InfluenzaB__ALN39762

SEQ ID NO: 28484 - protein, 584 aa, Artificial Sequence; identical to SEQ ID NO: 28289
  hemagglutinin__InfluenzaB__ALN39763

SEQ ID NO: 28485 - protein, 585 aa, Artificial Sequence; identical to SEQ ID NO: 28475
  hemagglutinin__InfluenzaB__ALN39764

SEQ ID NO: 28486 - protein, 584 aa, Artificial Sequence
  hemagglutinin__InfluenzaB__ALN39765
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVNNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLALFIVYMVSRDNVSCSICL

SEQ ID NO: 28487 - protein, 584 aa, Artificial Sequence; identical to SEQ ID NO: 28452
  hemagglutinin__InfluenzaB__ALN39766

SEQ ID NO: 28488 - protein, 584 aa, Artificial Sequence; identical to SEQ ID NO: 28289
  hemagglutinin__InfluenzaB__ALN39767

SEQ ID NO: 28489 - protein, 584 aa, Artificial Sequence; identical to SEQ ID NO: 28452
  hemagglutinin__InfluenzaB__ALN39768

SEQ ID NO: 28490 - protein, 584 aa, Artificial Sequence
  hemagglutinin__InfluenzaB__ALN39769
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHGRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28491 - protein, 584 aa, Artificial Sequence; identical to SEQ ID NO: 28448
  hemagglutinin__InfluenzaB__ALN39770

SEQ ID NO: 28492 - protein, 584 aa, Artificial Sequence; identical to SEQ ID NO: 28448
  hemagglutinin__InfluenzaB__ALN39771

SEQ ID NO: 28493 - protein, 584 aa, Artificial Sequence; identical to SEQ ID NO: 28289
  hemagglutinin__InfluenzaB__ALN39773

SEQ ID NO: 28494 - protein, 584 aa, Artificial Sequence; identical to SEQ ID NO: 28289
  hemagglutinin__InfluenzaB__ALN39774

SEQ ID NO: 28495 - protein, 585 aa, Artificial Sequence
  hemagglutinin__InfluenzaB__ALN39775
MQAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAEDAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVIDYMVQKSGKTGTITYQRGILLPQKVWCVSGRSKVIKGSLPLIGEADCLHEKYGGLNKSKPYYTGEHAKAVGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28496 - protein, 584 aa, Artificial Sequence
  hemagglutinin__InfluenzaB__ALN39776
MKAIIILLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28497 - protein, 584 aa, Artificial Sequence; identical to SEQ ID NO: 28452
  hemagglutinin__InfluenzaB__ALN39778

SEQ ID NO: 28498 - protein, 585 aa, Artificial Sequence; identical to SEQ ID NO: 28475
  hemagglutinin__InfluenzaB__ALN39779

SEQ ID NO: 28499 - protein, 584 aa, Artificial Sequence; identical to SEQ ID NO: 28289
  hemagglutinin__InfluenzaB__ALN39780

SEQ ID NO: 28500 - protein, 585 aa, Artificial Sequence; identical to SEQ ID NO: 28475
  hemagglutinin__InfluenzaB__ALN39781

SEQ ID NO: 28501 - protein, 585 aa, Artificial Sequence; identical to SEQ ID NO: 28439
  hemagglutinin__InfluenzaB__ALN39782

SEQ ID NO: 28502 - protein, 584 aa, Artificial Sequence
  hemagglutinin__InfluenzaB__ALN39783
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNLQTVEVPYICTEGEDQITVWGFHSDNKTQMKSLYGDSNPQKFTSSANGVTTHYVSQIGDFPDQTEDGGLPQSGRIVVDYMVQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28503 - protein, 585 aa, Artificial Sequence; identical to SEQ ID NO: 28451
  hemagglutinin__InfluenzaB__ALN39784

SEQ ID NO: 28504 - protein, 585 aa, Artificial Sequence; identical to SEQ ID NO: 28475
  hemagglutinin__InfluenzaB__ALN39785

SEQ ID NO: 28505 - protein, 584 aa, Artificial Sequence; identical to SEQ ID NO: 28289
  hemagglutinin__InfluenzaB__ALN39786

SEQ ID NO: 28506 - protein, 585 aa, Artificial Sequence; identical to SEQ ID NO: 28475
  hemagglutinin__InfluenzaB__ALN39787

SEQ ID NO: 28507 - protein, 585 aa, Artificial Sequence; identical to SEQ ID NO: 28475
  hemagglutinin__InfluenzaB__ALN39788

SEQ ID NO: 28508 - protein, 584 aa, Artificial Sequence
  hemagglutinin__InfluenzaB__ALN39790
MKAIIVLLMVVTSDADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQRFTSSANGVTTHYVSQIGDFPDQTEDGGLPQSGRIVVDYMVQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28509 - protein, 584 aa, Artificial Sequence
  hemagglutinin__InfluenzaB__ALN39791
MKAIIVLLMVVMSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSANGVTTHYVSQIGDFPDQTEDGGLPQSGRIVVDYMVQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28510 - protein, 585 aa, Artificial Sequence; identical to SEQ ID NO: 28475
  hemagglutinin__InfluenzaB__ALN39792

SEQ ID NO: 28511 - protein, 585 aa, Artificial Sequence; identical to SEQ ID NO: 28475
  hemagglutinin__InfluenzaB__ALN39793

SEQ ID NO: 28512 - protein, 584 aa, Artificial Sequence
  hemagglutinin__InfluenzaB__ALN39794
MKAIIILLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSADGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28513 - protein, 584 aa, Artificial Sequence; identical to SEQ ID NO: 28452
  hemagglutinin__InfluenzaB__ALN39795

SEQ ID NO: 28514 - protein, 585 aa, Artificial Sequence
  hemagglutinin__InfluenzaB__ALN39796
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAEDAPGGPYKIGTSGSCPNATNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28515 - protein, 584 aa, Artificial Sequence; identical to SEQ ID NO: 28452
  hemagglutinin__InfluenzaB__ALN39797

SEQ ID NO: 28516 - protein, 584 aa, Artificial Sequence
  hemagglutinin__InfluenzaB__ALN39798
MKAIIVLLMVVTSNADRICTGITSSSSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28517 - protein, 584 aa, Artificial Sequence; identical to SEQ ID NO: 28289
  hemagglutinin__InfluenzaB__ALN39799

SEQ ID NO: 28518 - protein, 584 aa, Artificial Sequence
  hemagglutinin__InfluenzaB__ALN39800
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALEKKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28519 - protein, 584 aa, Artificial Sequence; identical to SEQ ID NO: 28509
  hemagglutinin__InfluenzaB__ALN39801

SEQ ID NO: 28520 - protein, 584 aa, Artificial Sequence; identical to SEQ ID NO: 28452
  hemagglutinin__InfluenzaB__ALN39802

SEQ ID NO: 28521 - protein, 584 aa, Artificial Sequence; identical to SEQ ID NO: 28509
  hemagglutinin__InfluenzaB__ALN39803

SEQ ID NO: 28522 - protein, 584 aa, Artificial Sequence; identical to SEQ ID NO: 28448
  hemagglutinin__InfluenzaB__ALN39804

SEQ ID NO: 28523 - protein, 585 aa, Artificial Sequence; identical to SEQ ID NO: 28475
  hemagglutinin__InfluenzaB__ALN39805

SEQ ID NO: 28524 - protein, 585 aa, Artificial Sequence; identical to SEQ ID NO: 26989
  hemagglutinin__InfluenzaB__ACN29380

SEQ ID NO: 28525 - protein, 585 aa, Artificial Sequence; identical to SEQ ID NO: 27321
  hemagglutinin__InfluenzaB__EPI498048

SEQ ID NO: 28526 - protein, 585 aa, Artificial Sequence
  hemagglutinin__InfluenzaB__ANC28539
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28527 - protein, 585 aa, Artificial Sequence
  hemagglutinin__InfluenzaB__EPI827073
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGLHSDNEIQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28528 - protein, 585 aa, Artificial Sequence; identical to SEQ ID NO: 26747
  hemagglutinin__InfluenzaB__EPI244699

SEQ ID NO: 28529 - protein, 585 aa, Artificial Sequence; identical to SEQ ID NO: 26740
  hemagglutinin__InfluenzaB__EPI244702

SEQ ID NO: 28530 - protein, 584 aa, Artificial Sequence; identical to SEQ ID NO: 28129
  hemagglutinin__InfluenzaB__EPI540671

SEQ ID NO: 28531 - protein, 584 aa, Artificial Sequence
  hemagglutinin__InfluenzaB__EPI573303
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDDKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28532 - protein, 584 aa, Artificial Sequence
  hemagglutinin__InfluenzaB__EPI829466
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDDKTQMKSLYGDSNPQKFTSSANGVTTHYVSQIGDFPDQTEDEGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28533 - protein, 584 aa, Artificial Sequence
  hemagglutinin__InfluenzaB__EPI684429
MKAIIVLLMVVMSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKTQMKSLYGDSNPQKFTSSANGVTTHYVSQIGDFPDQTEDGGLPQSGRIVVDYMVQKPGKTGTIVYQRGVLLPQKVWCVSGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28534 - protein, 585 aa, Artificial Sequence; identical to SEQ ID NO: 26752
  hemagglutinin__InfluenzaB__AFH58447

SEQ ID NO: 28535 - protein, 585 aa, Artificial Sequence
  hemagglutinin__InfluenzaB__EPI173279
MKAIIVILMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28536 - protein, 585 aa, Artificial Sequence; identical to SEQ ID NO: 27321
  hemagglutinin__InfluenzaB__EPI163726

SEQ ID NO: 28537 - protein, 585 aa, Artificial Sequence; identical to SEQ ID NO: 28475
  hemagglutinin__InfluenzaB__EPI636340

SEQ ID NO: 28538 - protein, 585 aa, Artificial Sequence
  hemagglutinin__InfluenzaB__EPI645995
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHVRLSTHNVINAEDAPGGPYKIGTSGSCPNITNGNGFFATMAWAVPKNDKNKTATNPLTIEVPYICTEGEDQITVWGFHSDDETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28539 - protein, 584 aa, Artificial Sequence; identical to SEQ ID NO: 28129
  hemagglutinin__InfluenzaB__EPI539769

SEQ ID NO: 28540 - protein, 584 aa, Artificial Sequence; identical to SEQ ID NO: 28531
  hemagglutinin__InfluenzaB__EPI551249

SEQ ID NO: 28541 - protein, 584 aa, Artificial Sequence
  hemagglutinin__InfluenzaB__EPI544259
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKNQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28542 - protein, 584 aa, Artificial Sequence
  hemagglutinin__InfluenzaB__EPI592699
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKIQMKSLYGDSNPQKFTSSANGVTTHYVSQIGDFPDQTEDGGLPQSGRIVVDYMVQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28543 - protein, 584 aa, Artificial Sequence; identical to SEQ ID NO: 28452
  hemagglutinin__InfluenzaB__EPI592707

SEQ ID NO: 28544 - protein, 584 aa, Artificial Sequence
  hemagglutinin__InfluenzaB__EPI693094
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSESCPNATSKIGFFATMAWAVPKDNYKNATNPQTVEVPYICTEGEDQITVWGFHSDNKIQMKSLYGDSNPQKFTSSANGVTTHYVSQIGDFPDQTEDGGLPQSGRIVVDYMVQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28545 - protein, 585 aa, Artificial Sequence; identical to SEQ ID NO: 28475
  hemagglutinin__InfluenzaB__EPI678796

SEQ ID NO: 28546 - protein, 585 aa, Artificial Sequence
  hemagglutinin__InfluenzaB__EPI721064
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHVRLSTHNVINAEDAPGGPYKIGTSRSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28547 - protein, 585 aa, Artificial Sequence; identical to SEQ ID NO: 26756
  hemagglutinin__InfluenzaB__EPI328904

SEQ ID NO: 28548 - protein, 584 aa, Artificial Sequence
  hemagglutinin__InfluenzaB__EPI543191
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDKKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28549 - protein, 584 aa, Artificial Sequence; identical to SEQ ID NO: 28129
  hemagglutinin__InfluenzaB__EPI500359

SEQ ID NO: 28550 - protein, 584 aa, Artificial Sequence
  hemagglutinin__InfluenzaB__EPI543185
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPQTVEVPYICTEGEDQITVWGFHSDNKNQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28551 - protein, 584 aa, Artificial Sequence; identical to SEQ ID NO: 28289
  hemagglutinin__InfluenzaB__EPI536447

SEQ ID NO: 28552 - protein, 584 aa, Artificial Sequence; identical to SEQ ID NO: 26758
  hemagglutinin__InfluenzaB__NP_056660

SEQ ID NO: 28553 - protein, 584 aa, Artificial Sequence
  hemagglutinin__InfluenzaB__ABG85167
MKAIIVLLMVVTSNADRICTGITSSNSPHVVKTATQGEVNVTGVIPLTTTPTRSHFANLKGTQTRGKLCPNCFNCTDLDVALGRPKCMGNIPSAKVSILHEVKPVTSGCFPIMHDRTKIRQLPNLLRGYENIRLSTSNVINAETAPGGPYKVGTSGSCPNVANRNGFFNTMAWVIPKDNNKTAINPVTVEVPYICSEGEDQITVWGFHSDDKTQMERLYGDSNPQKFTSSANGVTTHYVSQIGGFPNQTEDEGLKQSGRIVVDYMVQKPGKTGTIVYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMNGLHDEILELDEKVDDLRADTISSQIELAVLLSNEGIINSEDEHLLALERKLKKMLGPSAVEIGNGCFETKHKCNQTCLDRIAAGTFNAGDFSLPTFDSLNITAASLNDDDLDNHTILLYYSTAASSLAVTLMIAIFIVYMVSRDNVSCSICL

SEQ ID NO: 28554 - protein, 584 aa, Artificial Sequence
  hemagglutinin__InfluenzaB__EPI376346
MKAIIVLLMVVTSNADRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQITVWGFHSDDKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28555 - protein, 584 aa, Artificial Sequence; identical to SEQ ID NO: 26854
  hemagglutinin__InfluenzaB__EPI368425

SEQ ID NO: 28556 - protein, 584 aa, Artificial Sequence; identical to SEQ ID NO: 26820
  hemagglutinin__InfluenzaB__ACH53430

SEQ ID NO: 28557 - protein, 585 aa, Artificial Sequence; identical to SEQ ID NO: 26645
  hemagglutinin__InfluenzaB__EPI331151

SEQ ID NO: 28558 - protein, 585 aa, Artificial Sequence
  hemagglutinin__InfluenzaB__EPI356777
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDDETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28559 - protein, 583 aa, Artificial Sequence; identical to SEQ ID NO: 26427
  hemagglutinin__InfluenzaB__CY018349

SEQ ID NO: 28560 - protein, 583 aa, Artificial Sequence
  hemagglutinin__InfluenzaB__AY581945
MKAIIVLLMVVTSNADRICTGITSSNSPHVVKTATQGEVNVTGVIPLTTTPTKSHFANLKGTKTRGKLCPNCLNCTDLDVALARPMCVGTTPSAKASILHEVRPVTSGCFPIMHDRTKIRQLPNLLRGYENIRLSTQNVINAERAPGGPYRLGTSGSCPNVTSRDGFFATMAWAVPRDNKTATNPLTVEVPYICTKGEDQITVWGFHSDNKTQMKNLYGDSNPQKFTSSANGVTTHYVSQIGGFPNQTEDGGLPQSGRIVVDYMVQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 28561 - protein, 584 aa, Artificial Sequence; identical to SEQ ID NO: 28308
  hemagglutinin__InfluenzaB__EPI541351

SEQ ID NO: 28562 - protein, 584 aa, Artificial Sequence
  hemagglutinin__InfluenzaB__EPI541760
MKAVIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28563 - protein, 585 aa, Artificial Sequence; identical to SEQ ID NO: 26887
  hemagglutinin__InfluenzaB__EPI477397

SEQ ID NO: 28564 - protein, 585 aa, Artificial Sequence
  hemagglutinin__InfluenzaB__EPI492571
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAEDAPGGPYKIGTSGSCPNVTNGNGFFATMAWAVPKNDKNKTATNPLTIEVPYICTEGEDQITVWGFHSDIETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28565 - protein, 585 aa, Artificial Sequence
  hemagglutinin__InfluenzaB__EPI498340
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINTEDAPGGPYKIGTSGSCPNVTNGNGFFATMAWAVPKNDKNKTATNPLTIEVPYICTEGEDQITVWGFHSDIETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28566 - protein, 585 aa, Artificial Sequence
  hemagglutinin__InfluenzaB__EPI516490
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAEDAPGGPYKIGTSGSCPNVTNGNGFFATMAWAVPKNDKNKTATNPLTIEVPYICTEGEDQITVWGFHSDNEIQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 28567 - protein, 584 aa, Artificial Sequence; identical to SEQ ID NO: 28129
  hemagglutinin__InfluenzaB__EPI538119

SEQ ID NO: 28568 - protein, 584 aa, Artificial Sequence; identical to SEQ ID NO: 28548
  hemagglutinin__InfluenzaB__EPI538125

SEQ ID NO: 28569 - protein, 584 aa, Artificial Sequence
  hemagglutinin__InfluenzaB__EPI556422
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDIKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28570 - protein, 584 aa, Artificial Sequence
  hemagglutinin__InfluenzaB__EPI614608
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPITSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDEKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28571 - protein, 584 aa, Artificial Sequence
  hemagglutinin__InfluenzaB__EPI614610
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDEKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEEYGGLNKSKPYYTGKHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28572 - protein, 585 aa, Artificial Sequence
  hemagglutinin__InfluenzaB__AAA43697
MKAIIVLLMVVTSNADRICTGITSSNSPHVVKTATQGEVNVTGVIPLTTTPTKSHFANLKGTKTRGKLCPKCLNCTDLDVALARPKCMGTIPSAKASILHEVKPVTSGCFPIMHDRTKIRQLPNLLRGYEHIRLSTHNVINAETAPGGPYKVGTSGSCPNVTNGNGFFATMAWAVPKNDNNKTATNPLTVEVPYICTEGEDQITVWGFHSDSETQMVKLYGDSKPQKFTSSANGVTTHYVSQIGGFPNQAEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMIAIFIVYMVSRDNVSCSICL

SEQ ID NO: 28573 - protein, 584 aa, Artificial Sequence
  hemagglutinin__InfluenzaB__EPI271545
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28574 - protein, 584 aa, Artificial Sequence
  hemagglutinin__InfluenzaB__AGB08329
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKIQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 28575 - protein, 584 aa, Artificial Sequence; identical to SEQ ID NO: 26755
  hemagglutinin__InfluenzaB__EPI294880

SEQ ID NO: 28576 - protein, 583 aa, Artificial Sequence; identical to SEQ ID NO: 26466
  hemagglutinin__InfluenzaB__CY018765

SEQ ID NO: 28577 - protein, 466 aa, Artificial Sequence
  neuraminidase_glycoprotein__InfluenzaB__AAN39743
MLPSTIQTLTLFLTSGGVLLSLYVSALLSYLLYSDILLKFSPTKVIAPTMSLDCANASNVQAVNHSATEEMTFLLPEPEWTYPRLSCQGSTFQKALLISPHRFGEAKGNSAPLIIREPFIACGPKECIHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISRCRFLKIREGRIIKEIFPTGRVEHTEECTCGFASNKTIECVCRDNSYTAKRPFVKLNVETDTAEIRLMCTETYLDTPRPDDGSITGPCESNGDKGNGGIKGGFVHQRMASRIGRWYSRTMSKTKRMGMELYVKYDGDPWTDSDALAPSGVMVSMEEPGWYSFGFEIKDKKCDVPCIGIEMVHDGGKKTWHSAATAIYCLMGSGQLLWDTVTGVDMAL

SEQ ID NO: 28578 - protein, 466 aa, Artificial Sequence
  neuraminidase_glycoprotein__InfluenzaB__AAN39747
MLPSTIQTLILFLTSGGVLLSLYVSALLSYLLYSDILLKFSPTKIIAPTMSLDCANASNVQAVNHSATKEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTKTYLDTPRPDDGSITGPCESNGDKGSGGIKGGFVHQRMASKIGRWYSRTMSKTKRMGMELYVKYDGDPWTDSDALAPSGVMVSIEEPGWYSFGFEIKDKKCDVPCIGIEMVHDGGKKTWHSAATAIYCLMGSGQLLWDTVTGVDMAL

SEQ ID NO: 28579 - protein, 466 aa, Artificial Sequence
  neuraminidase_glycoprotein__InfluenzaB__AAN39749
MLPSTIQTLTLFLTSGGVLLSLYVSALLSYLLYSDILLKFSPTKVIAPTMSLDCANASNVQAVNHSATEEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISRCRFLKIREGRIIKEIFPTGRVEHTEECTCGFASNKTIECACRDNSYTAKRPFVKLNVETDTAEIRLMCTETYLDTPRPDDGSITGPCESNGDKGNGGIKGGFVHQRMASRIGRWYSRTMSKTKRMGMELYVKYDGDPWTDSDALAPSGVMVSMEEPGWYSFGFEIKDKKCDVPCIGIEMVHDGGKKTWHSAATAIYCLMGSGQLLWDTVTGVDMAL

SEQ ID NO: 28580 - protein, 466 aa, Artificial Sequence
  neuraminidase_glycoprotein__InfluenzaB__AAN39751
MLPSTIQTLTLFLTSGGVLLSLYVSALLSYLLYSDILLKFSPTKVIAPTMSLDCANASNVQAVNHSATEEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISRCRFLKIREGRILKEIFPTGRVEHTEECTCGFASNKTIECACRDNSYTAKRPFVQLNVETDTAEIRLMCTETYLDTPRPDDGSITGPCESNGDKGNGGIKGGFVHQRMASRIGRWYSRTMSKTKRMGMDLYVKYDGDPWTDSDALAPSGVMVSMEEPGWYSFGFEIKDKKCDVPCIGIEMVHDGGKKTWHSAATAIYCLMGSGQLLWDTVTGVDMAL

SEQ ID NO: 28581 - protein, 466 aa, Artificial Sequence
  neuraminidase_glycoprotein__InfluenzaB__AAN39753
MLPSTIQTLTLFLTSGGVLLSLYVSALLSYLLYSDILLKFSPTKVIAPTMSLDCANASNVQAVNHSATEEMTFLLPEPEWTYPRLSCQGSTFQKALLISPHRFGEAKGNSAPLIIREPFIACGPKECKHFALTHYAAQPGEYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISRCRFLKIREGRIIKEIFPTGRVEHTEECTCGFASNKTIECACRDNSYTAKRPFVKLNVETDTAEIRLMCTETYLDTPRPDDGSITGPCESNGDKGNGGIKGGFVHQRMASRIGRWYSRTMSKTKRMGMELYVKYDGDPWTDSDALAPSGVMVSMEEPGWYSFGFEIKDKKCDVPCIGIEMVHDGGKKTWHSAATAIYCLMGSGQLLWDTVTGVDMAL

SEQ ID NO: 28582 - protein, 466 aa, Artificial Sequence
  neuraminidase_glycoprotein__InfluenzaB__AAN39759
MLPSTIQTLTLFLTSGGVLLSLYVSASLSYLLYSDILLKLSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMESKIGRWYSRTMSKTKRMGMGLYVKYDGDPWTDSDALALSGVMVSIEEPGWYSFGFEIKDKKCDVPCIGIEMVHDGGKETWHSAATAIYCLMGSGQLLWDTVTGVDMAL

SEQ ID NO: 28583 - protein, 466 aa, Artificial Sequence
  neuraminidase_glycoprotein__InfluenzaB__AAN39761
MLPSTIQTLTLFLTSGGVLLSLYVSASLSYLLYSDILLKFSQTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGSASGISECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 28584 - protein, 466 aa, Artificial Sequence
  neuraminidase_glycoprotein__InfluenzaB__AAN39769
MLPSTIQTLTLFLTSGGVLLSLYVSALLSYLLYSDILLKFSPTKIIAPTTSLDSANASNFQAVNHSATKEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMELYVKYDGDPWTDSDALAPSGVMVSIEEPGWYSFGFEIKDKKCDVPCIGIEMVHDGGKTTWHSAATAIYCLMGSGQLLWDTVTGVDMAL

SEQ ID NO: 28585 - protein, 466 aa, Artificial Sequence
  neuraminidase_glycoprotein__InfluenzaB__AAN39771
MLPSTIQTLTLFLTSGGVLLSLYVSALLSYLLYSDILLKFSPTKIIAPTTSLDSANASNFQAVNHSATKEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISKCRFLKIREGRIVKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMELYVKYDGDPWTDSDALDPSGVMVSIEEPGWYSFGFEIKDKKCDVPCIGIEMVHDGGKTTWHSAATAIYCLMGSGQLLWDTITGVDMAL

SEQ ID NO: 28586 - protein, 466 aa, Artificial Sequence
  neuraminidase_glycoprotein__InfluenzaB__AAN39773
MLPSTIQTLTLFLTSGGVLLSLYVSALLSYLLYSDILLKFSPTKIIAPTTSLDSANASNFQAVNHSATKEMTFLLPEPEWTYPRLSCQGSTFQKALLISPHRFGEAKGNSAPLIIREPFIACGPKECKHFALTHYAAQPGGYYNGTREDRNKLRHLISVNFGKIPTVENSIFHMAAWSGSACHDGREWTYIGVDGPDSNALIKIKYGEAYTDTYHSYANNILRTQESACNCIGGDCYLMITDGSASGISKCRFLKIREGRIVKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMELYVKYDGDPWTDSDALAPSGVMVSIEEPGWYSFGFEIKDKKCDVPCIGIEMVHDGGKTTWHSAATAIYCLMGSGQLLWDTITGVDMAL

SEQ ID NO: 28587 - protein, 466 aa, Artificial Sequence
  neuraminidase_glycoprotein__InfluenzaB__AAN39775
MLPSTIQTLTLFLTSGGVLLSLYVSALLSYLLYSDILLKFSPTKIIAPTTSLDSANASNFQAVNHSATKEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGKEWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMELYVKYDGDPWTDSDALAPSGVMVSIEEPGWYSFGFEIKDKKCDVPCIGIEMVHDGGKTTWHSAATAIYCLMGSGQLLWDTVTGVDMAL

SEQ ID NO: 28588 - protein, 466 aa, Artificial Sequence
  neuraminidase_glycoprotein__InfluenzaB__AAN39777
MLPSTIQTLTLFLTSGGVLLSLYVSASLSYLLYSDILLKFSQTEITAPTMPLDCANASNVQAVNRSATKGVTLLPPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGNKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 28589 - protein, 466 aa, Artificial Sequence; identical to SEQ ID NO: 28584
  neuraminidase_glycoprotein__InfluenzaB__AAN39779

SEQ ID NO: 28590 - protein, 466 aa, Artificial Sequence
  neuraminidase_glycoprotein__InfluenzaB__AAN39781
MLPSTIQTLTLFLTSGGVLLSLYVSASLSYLLYSDILLKFSSTEITAPTMPLNCANASNVQAVNHSATKGVTLPLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGDCYLMITDGSASGVSECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKNKRMGMGLYVKYDGDPWIDSDALTLSGVMVSMEEPGWYSFGFEIKDKKCDVPCIGIEMVHDGGKETWHSAATAIYCLMGSGQLLWDTVTGVNMAL

SEQ ID NO: 28591 - protein, 466 aa, Artificial Sequence
  neuraminidase_glycoprotein__InfluenzaB__AAN39783
MLPSTIQTLTLFLTSGGVLLSLYVSASLSYLLYSDILLKFSQTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGSASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 28592 - protein, 466 aa, Artificial Sequence
  neuraminidase_glycoprotein__InfluenzaB__AAN39785
MLPSTIQTLTLFLTSGGVLLSLYVSALLSYLLYSDILLKFSPTKVIAPTMSLDYANASNVQAVNHSATEEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISRCRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMTSRIGRWYSRTMSKTKRMGMELYVKYDGDPWTDSDALAPSGVMVSMEEPGWYSFGFEIKDKKCDVPCIGIEMVHDGGKKTWHSAATAIYCLMGSGQLLWDTVTGVDMAL

SEQ ID NO: 28593 - protein, 466 aa, Artificial Sequence
  neuraminidase_glycoprotein__InfluenzaB__AAN39787
MLPSTIQTLTLFLTSGGVLLSLYVSALLSYLLYSDILLKFSPTKVIAPTMSLDYANASNVQAVNHSATEEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISRCRFLKIREGRIIKEIFPTGRVEHTEECTCGFASNKTIECACRDNSYTAKRPFVKLNVETDTAEIRLMCTETYLDTPRPDDGSITGPCESNGDKGNGGIKGGFVHQRMASRIGRWYSRTMSKTKRMGMELYVKYDGDPWTDSDALAPSGVMVSMEEPGWYSFGFEIKDKKCDVPCIGIEMVHDGGKKTWHSAATAIYCLMGSGQLLWDTVTGVDMAL

SEQ ID NO: 28594 - protein, 466 aa, Artificial Sequence
  neuraminidase_glycoprotein__InfluenzaB__AAN39795
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETRGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGDCYLMITDGSASGTSKCRFLKIREGRIIKEIFPTGRVEHTEECTCGFASNKTIECACRDNNYTAKRPFVKLNVETDAAEIRLMCTETYLDTPRPDDGSITGPCESNGDKGRGGIKGGFVHQRMASKIGRWYSRTMSKTERMGMELYVKYDGDPWTDSDALALSGVMVSMEEPGWYSFGFEIKDKKCDVPCIGIEMVHDGGKKTWHSAATAIYCLMGSGQLLWDTVTGVDMAL

SEQ ID NO: 28595 - protein, 466 aa, Artificial Sequence; identical to SEQ ID NO: 28579
  neuraminidase_glycoprotein__InfluenzaB__AAN39797

SEQ ID NO: 28596 - protein, 466 aa, Artificial Sequence
  neuraminidase_glycoprotein__InfluenzaB__AAN39799
MLPSTIQTLTLFLTSGGVLLSLYVSALLSYLLYSDVLLKFSPTKIIAPTMSLDCANASNVQAVNHSATEEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIEYGEAYTDTYHSYAYNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMELYVKYDGDPWTDSDALAPSGVMVSMEEPGWYSFGFEIKDKKCDVPCIGIEMVHDGGKKTWHSAATAIYCLMGSGQLLWDTVTGVDMAL

SEQ ID NO: 28597 - protein, 466 aa, Artificial Sequence
  neuraminidase_glycoprotein__InfluenzaB__AAN39801
MLPSTIQTLTLFLTSGGVLLSLYVSASLSYLLYSDILLKFSPTEITAPTMPLDCANASNAQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 28598 - protein, 466 aa, Artificial Sequence
  neuraminidase_glycoprotein__InfluenzaB__AAN39803
MLPSTIQTLTLFLTSGGVLLSLYVSASLSYLLYSDILLKFSPTEITAPKVPLDCANASNVQAVNRSATKGMTLLLSEPEWTYPRLSCQGSTFQKALLISPHRFGETRGNSAPLIIREPFIACGPKECKHFALTHYAAQPGGYYNGTREDRNKLRHLISVKLGKIPTVENSIFHMAAWSGSACHDGREWTYIGLDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGRGGIKGGFVHQRMASKIGRWYSRTMSKTERMGMELYVKYDGDPWTDSDALAPSGVMVSMKEPGWYSFGFEIKDKKCDVPCIGIEMVHDGGKETWHSAATAIYCLMGSGQLLWDTVTGVDMAL

SEQ ID NO: 28599 - protein, 466 aa, Artificial Sequence
  neuraminidase__InfluenzaB__ABA02232
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPENNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 28600 - protein, 466 aa, Artificial Sequence
  neuraminidase__InfluenzaB__ABI84039
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKYTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28601 - protein, 466 aa, Artificial Sequence
  neuraminidase__InfluenzaB__ABI84051
MLPSTIQTLTLFLTSGGVLLSLYVSASLSYLLYSDILLRFSQTEITAPIMPLDCANASNVQAVNHSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 28602 - protein, 466 aa, Artificial Sequence
  neuraminidase__InfluenzaB__ABI84062
MLPSTIQTLTLFLTSGGVLLSLYVSASLSYLLYSDILLKFSPTEIIAPIMPLDCANASNVQAVNRSTTKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGPASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 28603 - protein, 466 aa, Artificial Sequence
  neuraminidase__InfluenzaB__ABL76280
MLPSTIQTLTLFLTSGGVLLSLYVSASLSYLLYSDILLKFSPTEITAPTMPLNCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGDCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWIDSDALTLSGVMVSMEEPGWYSFGFEIKDKKCDVPCIGIEMVHDGGKKTWHSAATAIYCLMGSGQLLWDTVTGVDMAL

SEQ ID NO: 28604 - protein, 466 aa, Artificial Sequence
  neuraminidase__InfluenzaB__ABL76302
MLPSTIQTLTLFLTSGGVLLSLYVSASLSYLLYSDILLKFPPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDPLALSGVMVSMEEPGWYSFGFEIKDKKCDVPCIGIEMVHDGGKETWHSAATAIYCLMGSGQMLWDTVTGVDMAL

SEQ ID NO: 28605 - protein, 466 aa, Artificial Sequence
  neuraminidase__InfluenzaB__ABL76313
MLPSTIQTLTLFLTSGGVLLSLYVSASLSYLLYSDILLKFSPKEITAPTMPLNCANASNVQAVNRSATKGVTFPLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGDCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWIDSDALTLSGVMVSVEEPGWYSFGFEIKDKKCDVPCIGIEMVHDGGKTTWHSAATAIYCLMGSGQLLWDTVTGVDMAL

SEQ ID NO: 28606 - protein, 466 aa, Artificial Sequence
  neuraminidase__InfluenzaB__ABL76335
MLPSTIQTLTLFLTSGGVLLSLYVSASLSYLLYSDILLKFSPTEITAPTMPLNCANASNVQAVNRSATKGVTLPLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGDCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWIDSDALTLSGVMVSMEEPGWYSFGFEIKDKKCDVPCIGIEMVHDGGKTTWHSAATAIYCLMGSGQLLWDTVTGVDMAL

SEQ ID NO: 28607 - protein, 466 aa, Artificial Sequence
  neuraminidase__InfluenzaB__ABL76346
MLPSTIQTLTLFLTSGGVLLSLYVSASLSYLLYSDILLKFSPKEITTPTMPLNCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGDCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWIDSDALTLSGVMVSMEEPGWYSFGFEIKDKKCDVPCIGIEMVHDGGKTTWHSAATAIYCLMGSGQLLWDTVTGVDMAL

SEQ ID NO: 28608 - protein, 466 aa, Artificial Sequence; identical to SEQ ID NO: 28607
  neuraminidase__InfluenzaB__ABL76357

SEQ ID NO: 28609 - protein, 466 aa, Artificial Sequence
  neuraminidase__InfluenzaB__ABL76368
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSGALALSGVMVSMEEPGWYSFGFEIKDKKCDVPCIGIEMVHDGGKETWHSAATAIYCLMGSGQLLWDTVTGVDMAL

SEQ ID NO: 28610 - protein, 467 aa, Artificial Sequence
  neuraminidase__InfluenzaB__ABL76379
MLPSTIQTLTLFLTSGGVLLSLYVSASLSYLLYSDILLKFSPTEITAPTMPLDCANASNVQAVNRSATKGVTFLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 28611 - protein, 466 aa, Artificial Sequence
  neuraminidase__InfluenzaB__ABL76390
MLPSTIQTLTLFLTSGGVLLSLYVSASLSYLLYSDILLKFSPTEITAPTMPLDCANASNVQAVNRSSTKGVTFLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGSCESDGDKGSGGIKGGFVHQRMASKIGRWYSRTMSKTKRMGMGLYVRYDGDPWTDSSALALSGVMVSMEEPGWYSFGFEIKDKKCDVPCIGIEMVHDGGKETWHSAATAIYCLMGSGQLLWDTVTGVDMAL

SEQ ID NO: 28612 - protein, 466 aa, Artificial Sequence
  neuraminidase__InfluenzaB__ABL76412
MLPSTIQTLTLFLTSGGVLLSLYVSASLSYLLYSDILLKFSPTEITAPTMPLDCANASNVQAVNRSATKGVTLLIPEPEWTYPRLSCPGSTFQKALLISPHRFGETKGNSAPLIIREPFIACGPKECKHFALTHYTAQPGGYYNGTRGDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 28613 - protein, 466 aa, Artificial Sequence
  neuraminidase__InfluenzaB__ABL76423
MLPSTIQTLTLFLTSGGVLLSLYVSASLSYLLYSDILLKFSPTEITAPTMPLDCANASNVQAVNHSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALAFSGVMVSMEEPGWYSFGFEIKDKKCDVPCIGIEMVHDGGKETWHSAATAIYCLMGSGQLLWDTVTGVDMAL

SEQ ID NO: 28614 - protein, 466 aa, Artificial Sequence
  neuraminidase__InfluenzaB__ABL76434
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIRDKKCDVPCIGIEMVHDGGKETWHSAATAIYCLMGSGQLLWDTVTGVDMAL

SEQ ID NO: 28615 - protein, 466 aa, Artificial Sequence
  neuraminidase__InfluenzaB__ABL76456
MLPSTIQTLTLFLTSGGVLLSLYVSASLSYLLYSDILLKFSPTEITAPTMPLDCANASNVQAVNRSATKGVKLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 28616 - protein, 466 aa, Artificial Sequence
  neuraminidase__InfluenzaB__ABL76467
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 28617 - protein, 466 aa, Artificial Sequence
  neuraminidase__InfluenzaB__ABL76478
MLPSTIQTLTLFLTSGGVLLSLYVSASLSYLLYSDILLKFSPTEITAPTMPLDCANASNVQAVNRSATKGVKLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTKTYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 28618 - protein, 466 aa, Artificial Sequence
  neuraminidase__InfluenzaB__ABL76522
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 28619 - protein, 466 aa, Artificial Sequence
  neuraminidase__InfluenzaB__ABL76533
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGKRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 28620 - protein, 466 aa, Artificial Sequence
  neuraminidase__InfluenzaB__ABL76544
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGERNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 28621 - protein, 466 aa, Artificial Sequence; identical to SEQ ID NO: 28619
  neuraminidase__InfluenzaB__ABL76566

SEQ ID NO: 28622 - protein, 466 aa, Artificial Sequence
  neuraminidase__InfluenzaB__ABL76588
MLPSTIQTLTLFLTSGGVLLSLYVSASLSYLLYSDILLKFSPTEITAPTMPLDYANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 28623 - protein, 466 aa, Artificial Sequence; identical to SEQ ID NO: 28618
  neuraminidase__InfluenzaB__ABL76599

SEQ ID NO: 28624 - protein, 466 aa, Artificial Sequence; identical to SEQ ID NO: 28618
  neuraminidase__InfluenzaB__ABL76610

SEQ ID NO: 28625 - protein, 466 aa, Artificial Sequence
  neuraminidase__InfluenzaB__ABL76621
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGEKGSGGIKGGFVHQRMASKIGRWYSRTMSKTKRMGMGLYVKYDGDPWADSDALALSGVMVSMEEPGWYSFGFEIKDKKCDIPCIGIEMVHDGGKETWHSAATAIYCLMGSGQLLWDTVTGVDMAL

SEQ ID NO: 28626 - protein, 466 aa, Artificial Sequence
  neuraminidase__InfluenzaB__ABL76632
MLPSTIQTLTLFLTSGGVLLSLYVSASLSYLLYSDILLKFSQTEITAPIMPLDCANASNVQAVNRSATKGVTLLLPEPEWTYPRLSCPGSTFQKALLISPHRFGETKGNSAPLIIREPFIACGPTECKHFALTHYAAQPGGYYNGTREDRNKMRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAVYCLMGSGQLLWDTVTGVDMAL

SEQ ID NO: 28627 - protein, 466 aa, Artificial Sequence
  neuraminidase__InfluenzaB__ABL76643
MLPSTIQTLTLFLTSGGVLLSLYVSASLSYLLYSDILLKFSQTEITAPIMPLDCANASNVQAVNRSATKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 28628 - protein, 466 aa, Artificial Sequence
  neuraminidase__InfluenzaB__ABL76654
MLPSTIQTLTLFLTSGGVLLSLYVSASLSYLLYSDILLKFSQTEITAPIMPLDCANASNVQAVNRSTTKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 28629 - protein, 466 aa, Artificial Sequence
  neuraminidase__InfluenzaB__ABL76665
MLPSTIQTLTLFLTSGGVLLSLYVSASLSYLLYSDILLKFSQTEITAPIMPLDCANASNVQAVNRSATKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCEFDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 28630 - protein, 466 aa, Artificial Sequence
  neuraminidase__InfluenzaB__ABL76676
MLPSTIQTLTLFLTSGGVLLSLYVSASLSYLLYSDILLKFSQTGITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 28631 - protein, 466 aa, Artificial Sequence
  neuraminidase__InfluenzaB__ABL76687
MLPSTIQTLTLFLTSGGVLLSLYVSASLSYLLYSDILLKFSQTEITAPIMPLDCANASNVQAVNRSATKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCEFDGDKGSGGIKGGFVHQRMASKIGRWYSRTMSKTKRMGMGLYVKYDGDPWTDSEALALSGVMVPMEEPGWYSFGFEIKDKKCDVPCIGIEMVHDGGKTTWHSAATAIYCLMGSGQLLWDTVTGVDMAL

SEQ ID NO: 28632 - protein, 466 aa, Artificial Sequence
  neuraminidase__InfluenzaB__ABL76698
MLPSTIQTLTLFLTSGGVLLSLYVSASLSYLLYSDILLKFSPTEITAPTMPLDCANASNVQAVNRSATKGMTLLLPEPEWTYPRLSCPGSTFQKALLISPHRFGETRGNSAPLTIREPFIACGPKECKHFALTHYAAQPGGYYNGTREDRNKLRHLISVKLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGRGGIKGGFVHQRMASKIGRWYSRTMSKTERMGMELYVKYDGDPWTDSEALAPSGVMVSMEEPGWYSFGFEIKDKKCDVPCIGIEMVHDGGKKTWHSAATAIYCLMGSGQLLWDTVTGVDMAL

SEQ ID NO: 28633 - protein, 466 aa, Artificial Sequence
  neuraminidase__InfluenzaB__ABL76720
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWRSAATAIYCLMGSGQLLWDTVTGVDMAL

SEQ ID NO: 28634 - protein, 466 aa, Artificial Sequence
  neuraminidase__InfluenzaB__ABL76731
MLPSTIQTLTLFLTSGGVLLSLYVSASLSYLLYSDILLKFSPTEITAPTMPLDCANASNVHAVNRSATKGVTLLLPEPEWTYPRLSCPGSTFQKALLISPHRFGETKGNSAPLIIREPFIACGPNECKHFAITHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28635 - protein, 466 aa, Artificial Sequence
  neuraminidase__InfluenzaB__ABL76742
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28636 - protein, 466 aa, Artificial Sequence
  neuraminidase__InfluenzaB__ABL76753
MLPSTIQTLTLFLTSGGVLLSLYVSASLSYLLYSDILLKFSQTEITAPIMPLDCANASNVQAVNRSATKGVTLLLPEPEWTYPRLSCPGSTFQKALLISPHRFGETTGNSAPLIIREPFIACGPKECKHFALTHYAAQPGGYYNGTREDRNKLRHLISVKLGKIPTVENSIFHMAAWSGSACHDGREWTYIGVDGPDNNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 28637 - protein, 466 aa, Artificial Sequence; identical to SEQ ID NO: 28606
  neuraminidase__InfluenzaB__ABL76764

SEQ ID NO: 28638 - protein, 466 aa, Artificial Sequence; identical to SEQ ID NO: 28606
  neuraminidase__InfluenzaB__ABL76775

SEQ ID NO: 28639 - protein, 466 aa, Artificial Sequence
  neuraminidase__InfluenzaB__ABL76797
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVNMAL

SEQ ID NO: 28640 - protein, 466 aa, Artificial Sequence
  neuraminidase__InfluenzaB__ABL76819
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 28641 - protein, 466 aa, Artificial Sequence
  neuraminidase__InfluenzaB__ABL76830
MLPSTIQTLTLFLTSGGVLLSLYVSASLSYLLYSDILLKFSPTKITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTKTYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 28642 - protein, 466 aa, Artificial Sequence
  neuraminidase__InfluenzaB__ABL76852
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMESKIGRWYSRTMSKTKRMGMGLYVKYDGDPWTDSDALALSGVMVSIEEPGWYSFGFEIKDKKCDVPCIGIEMVHDGGKETWHSAATAIYCLMGSGQLLWDTVTGVDMAL

SEQ ID NO: 28643 - protein, 466 aa, Artificial Sequence
  neuraminidase__InfluenzaB__ABL76863
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAM

SEQ ID NO: 28644 - protein, 466 aa, Artificial Sequence
  neuraminidase__InfluenzaB__ABL76874
MLPSTIQTLTLFLTSGGVLLSLYVSASLSYLLYSDILLKFSPTEITAPTMPLDCANASNVQAVNSSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIKLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 28645 - protein, 466 aa, Artificial Sequence
  neuraminidase__InfluenzaB__ABL76885
MLPSTIQTLTLFLTSGGVLLSLYVSASLSYLLYSDILLKFSQTEITAPTMPLDYANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 28646 - protein, 466 aa, Artificial Sequence
  neuraminidase__InfluenzaB__ABL76896
MLPSTIQTLTLFLTSGGVLLSLYVSASLSYLLYSDILLKFSQTEITAPTMPLDCANASNVQAVNRSATKGVTLLLPEPEWMYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDAVTGVDMAL

SEQ ID NO: 28647 - protein, 466 aa, Artificial Sequence
  neuraminidase__InfluenzaB__ABL76918
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALALIGVMVSMEEPGWYSFGFEIKDKKCDVPCIGIEMVHDGGKETWHSAATAIYCLMGSGQLLWDTVTGVNMAL

SEQ ID NO: 28648 - protein, 466 aa, Artificial Sequence
  neuraminidase__InfluenzaB__ABL76962
MLPSTIQTLTLFLTSGGVLLSLYVSALLSYLLYSDILLKFSPTKIIAPTMSLDCANASNVQAVNHSATEEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMELYVKYDGDPWTDSDALAPSGVMVSMEEPGWYSFGFEIKDKKCDVPCIGIEMVHDGGKKTWHSAATAIYCLMGSGQLLWDTVTGVDMAL

SEQ ID NO: 28649 - protein, 466 aa, Artificial Sequence; identical to SEQ ID NO: 28579
  neuraminidase__InfluenzaB__ABL76973

SEQ ID NO: 28650 - protein, 466 aa, Artificial Sequence
  neuraminidase__InfluenzaB__ABL76984
MLPSTIQTLTLFLTSGGVLLSLYVSASLSYLLYSDILLKFSQTEITAPTMPLDCANASNVQAVNLSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGNCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKRTWHSAATAIYCLMGSGQLLWDTVTGVDMAL

SEQ ID NO: 28651 - protein, 466 aa, Artificial Sequence; identical to SEQ ID NO: 28606
  neuraminidase__InfluenzaB__ABL77006

SEQ ID NO: 28652 - protein, 466 aa, Artificial Sequence; identical to SEQ ID NO: 28650
  neuraminidase__InfluenzaB__ABL77017

SEQ ID NO: 28653 - protein, 466 aa, Artificial Sequence
  neuraminidase__InfluenzaB__ABL77028
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 28654 - protein, 466 aa, Artificial Sequence
  neuraminidase__InfluenzaB__ABL77039
MLPSTIQTLTLFLTSGGVLLSLYVSASLSYLLYSDILLKFSPTETTAPTMPLDCANASNVQAVNCSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 28655 - protein, 466 aa, Artificial Sequence
  neuraminidase__InfluenzaB__ABL77050
MLPSTIQTLTLFLTSGGVLLSLYVSASLSYLLYSDILLKFSPTEITAPAMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 28656 - protein, 466 aa, Artificial Sequence
  neuraminidase__InfluenzaB__ABL77072
MLPSTIQTLTLFLTSGGVLLSLYVSALLSYLLYSDILLKFSPTKIIAPTTSLDSANASNFQAVNHSATKEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMELYVKYDGDPWTDSDALAPSGVMVSIKESGWYSFGFEIKDKKCDVPCIGIEMVHDGGKTTWHSAATAIYCLMGSGQLLWDTVTGVDMAL

SEQ ID NO: 28657 - protein, 466 aa, Artificial Sequence; identical to SEQ ID NO: 28584
  neuraminidase__InfluenzaB__ABL77083

SEQ ID NO: 28658 - protein, 466 aa, Artificial Sequence; identical to SEQ ID NO: 28584
  neuraminidase__InfluenzaB__ABL77094

SEQ ID NO: 28659 - protein, 466 aa, Artificial Sequence
  neuraminidase__InfluenzaB__ABL77105
MLPSTIQTLTLFLTSGGVLLSLYVSASLSYLLYSDILLKFSSTEITAPTMPLDCANASNVQAVNRSATEGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 28660 - protein, 466 aa, Artificial Sequence; identical to SEQ ID NO: 28584
  neuraminidase__InfluenzaB__ABL77127

SEQ ID NO: 28661 - protein, 466 aa, Artificial Sequence
  neuraminidase__InfluenzaB__ABL77138
MLPSTIQTLTLFLTSGGVLLSLYVSALLSYLLYSDILLKFSPTKIIAPTTSLDSANASNFQAVNHSATKEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMELYVKYDGDPWTDSDALAPSGVMVSIEEPGWYSFGFEIKDKKCDVPCIGIEMVHDGGKTTWYSAATAIYCLMGSGQLLWDTVTGVDMAL

SEQ ID NO: 28662 - protein, 466 aa, Artificial Sequence; identical to SEQ ID NO: 28584
  neuraminidase__InfluenzaB__ABL77149

SEQ ID NO: 28663 - protein, 466 aa, Artificial Sequence
  neuraminidase__InfluenzaB__ABL77160
MLPSTIQTLTLFLTSGGVLLSLYVSASLSYLLYSDILLKFSQTKITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGSASGISECRFLKIREGRIIKEIFPTGRVKHTEECTCGFASNKTIECACRDNSYTAKRPFVKLNVETDTAEIRLMCTETYLDTPRPNDGSITGPCESDGDRGSGGIKGGFVHQRMESKIGRWYSRTMSKTKRMGMGLYVKYDGDPWTDSEALALSGVMVSMEEPGWYSFGFEIKDKKCDVPCIGIEMVHDGGKTTWHSAATTIYCLMGSGQLLWDTVTGVDMAL

SEQ ID NO: 28664 - protein, 466 aa, Artificial Sequence; identical to SEQ ID NO: 28616
  neuraminidase__InfluenzaB__ABL77171

SEQ ID NO: 28665 - protein, 466 aa, Artificial Sequence
  neuraminidase__InfluenzaB__ABL77182
MLPSTIQTLTLFLTSGGVLLSLYVSALLSYLLYSDILLKFSPTKIIAPTTSLDSANASNFQAVNHSATKEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISKCRFLKIREGRIVKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMELYVKYDGDPWTDSDALAPSGVMVSIEEPGWYSFGFEIKDKKCDVPCIGIEMVHDGGKTTWHSAATAIYCLMGSGQLLWDTITGVDMAL

SEQ ID NO: 28666 - protein, 466 aa, Artificial Sequence; identical to SEQ ID NO: 28591
  neuraminidase__InfluenzaB__ABL77193

SEQ ID NO: 28667 - protein, 466 aa, Artificial Sequence
  neuraminidase__InfluenzaB__ABL77204
MLPSTIQTLTLFLTSGGVLLSLYVSASLSYLLYSDILLKFSPTEITAPTMPLDCANASNVQAVNRSATKGVTLLIPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNSALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 28668 - protein, 466 aa, Artificial Sequence
  neuraminidase__InfluenzaB__ABL77215
MLPSTIQTLTLFLTSGGVLLSLYVSASLSYLLYSDILLKFPSTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALAFSGVMVSMEEPGWYSFGFEIKDKKCDVPCIGIEMVHDGGKETWHSAATAIYCLMGSGQLLWDTVTGVNMAL

SEQ ID NO: 28669 - protein, 466 aa, Artificial Sequence; identical to SEQ ID NO: 28627
  neuraminidase__InfluenzaB__ABL77226

SEQ ID NO: 28670 - protein, 466 aa, Artificial Sequence
  neuraminidase__InfluenzaB__ABL77237
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28671 - protein, 466 aa, Artificial Sequence
  neuraminidase__InfluenzaB__ABL77248
MLPSTIQTLTLFLTSGGVLLSLYVSALLSYLLYSDILLKFSPTKIIAPTMSLDCANASNVQAANHSATKEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGEKGRGGIKGGFVHQRMASKIGRWYSRTMSKTERMGMELYVKYDGDPWTDSDALAPSGVMVSMKEPGWYSFGFEIKDKKCDVPCIGIEMVHDGGKKTWHSAATAIYCLMGSGQLLWDTVTGVDMAL

SEQ ID NO: 28672 - protein, 466 aa, Artificial Sequence
  neuraminidase__InfluenzaB__ABL77259
MLPSTIQTLTLFLTSGGVLLSLYVSASLSYLLYSDILLKFSPTEITAPKVPLDCANASNVQAVNRSATKGMTLLLSEPEWTYPRLSCQGSTFQKALLISPHRFGETRGNSAPLIIREPFIACGPKECKHFALTHYAAQPGGYYNGTREDRNKLRHLISVKLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGRGGIKGGFVHQRMASKIGRWYSRTMSKTERMGMELYVKYDGDPWTDSDALAPSGVMVSMKEPGWYSFGFEIKDKKCDVPCIGIEMVHDGGKKTWHSAATAIYCLMGSGQLLWDTVTGVDMAL

SEQ ID NO: 28673 - protein, 466 aa, Artificial Sequence
  neuraminidase__InfluenzaB__ABL77270
MLPSTIQTLTLFLTSGGVLLSLYVSASLSYLLYSDILLKFSPTEITAPTMPLDCANASNVQAVNRSATKGMTLLLPEPEWTYPRLSCPGSTFQKALLISPHRFGETRGNSAPLIIREPFIACGPKECKHFALTHYAAQPGGYYNGTREDRNKLRHLISVKLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGRGGIKGGFVHQRMASKIGRWYSRTMSKTERMGMELYVKYDGDPWTDSEALAPSGVMVSMEEPGWYSFGFEIKDKKCDVPCIGIEMVHDGGKKTWHSAATAIYCLMGSGQLLWDTVTGVDMAL

SEQ ID NO: 28674 - protein, 466 aa, Artificial Sequence
  neuraminidase__InfluenzaB__ABL77281
MLPSTIQTLTLFLTSGGVLLSLYVSVSLSYLLYSDILLRFSPTEITAPTMPLDCANASNVQAVNRSATKGMTLRLPEPEWTYPRLSCPGSTFQKALLISPHRFGETRGNSAPLIIREPFIACGPKECKHFALTHYAAQPGGYYNGTREDRNKLRHLISVKLGKIPTVENSIFHMAAWSGSACHDGREWTYIGVDGPDSNALIKIKYGEAYTDTYHSYANNILRTQESACNCIGGDCYLMITDGSASEISKCRFLKIREGRIIKEIFPTGRVEHTEECTCGFASNKTIECACRDNSYTAKRPFVKLNVETDTAEIRLMCTETYLDTPRPDDGSITGPCESNGDKGRGGIKGGFVHQRMASKIGRWYSRTMSKTERMGMELYVKYDGDPWTDSEALAPSGVMVSMEEPGWYSFGFEIKDKKCDVPCIGIEMVHDGGKKTWHSAATAIYCLMGSGQLLWDTVTGVDMAL

SEQ ID NO: 28675 - protein, 466 aa, Artificial Sequence
  neuraminidase__InfluenzaB__ABL77292
MLPSTIQTLTLFLTSGGVLLSLYVSASLSYLLYSGVLLKFSPTEITAPTMPLDCANASNVQAVNRSATKGVTLLLPEPEWTYPRLSCPGSTFQKALLISPHRFGETRGNSAPLIIREPFIACGPKECKHFALTHYAAQPGGYYNGTREDRNKMRHLISVKLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGLGGIKGGFVHQRMASKIGRWYSRTMSKTERMGMELYVKYDGDPWTDSDALALSGVMVSMEEPGWYSFGFEIKDKKCDVPCIGIEMVHDGGKKTWHSAATAIYCLMGSGQLLWDTVTGVDMAL

SEQ ID NO: 28676 - protein, 465 aa, Artificial Sequence
  neuraminidase__InfluenzaB__ABL77303
MLPSTIQTLTLFLTSGGVLLSLYVSALLSYLLYSDILLKFSPKIIAPTISLDCANASNVQAVNHSATKEMTFLLPEPEWTYPRLSCQGSIFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGRGGVKGGFVHQRIASKIGRWYSRTMSKTERMGMELYVKYDGDPWTDSDALAPSGVMVSMEEPGWYSFGFEIKDKKCDVPCIGIEMVHDGGKKTWHSAATAIYCLMGSGQLLWDTVTGVDMAL

SEQ ID NO: 28677 - protein, 465 aa, Artificial Sequence
  neuraminidase__InfluenzaB__ABL77314
MLPSTIQTLTLFLTSGGVLLSLYVSALLSYLLYSDVLLKFSPKIIAPTMSLDCANASNVQAVNHSATEEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGHGGIKGGFVHQRMASKIGRWYSRTMSKTKRMGMELYVKYDGDPWTDSDALAPSGVMVSMEEPGWYSFGFEIRDKKCDVPCIGIEMVHDGGKKTWHSAATAIYCLMGSGQLLWDTVTGVDMAL

SEQ ID NO: 28678 - protein, 466 aa, Artificial Sequence
  neuraminidase__InfluenzaB__ABL77325
MLPSTIQTLTLFLTSGGVLLSLYVSALLSYSLYSDILLKFSPTKTIAPTMSLDCANASNVQAVNHSATKGMTLLLPEPEWTYPRLSCQGSTFQKALLISPHRFGETKGNSAPLIIREPFIACGPKECKHFALTHYAAQPGGYYNGTREDRNKLRHLISVSLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVDHTEECTCGFASNKTIECACRDNSYTAKRPFVKLNVETDTAEIRLMCTETYLDTPRPDDGSITGPCESNGDKGRGGIKGGFVHQRMASKIGRWYSRTMSKTERLGMELYVKYDGDPWTDSDALAPSGVMVSAEEPGWYSFGFEIKDKKCDVPCIGIEMVHDGGKKTWHSAATAIYCLMGSGQLLWDTVTGVDMAL

SEQ ID NO: 28679 - protein, 466 aa, Artificial Sequence
  neuraminidase__InfluenzaB__ABL77336
MLPSTIQTLTLFLTSGGVLLSLYVSASLSYLLYSDILLKFSPTEITAPPMPLDCANASNVQAVNRSATKGVTLLLPEPEWTYPRLSCPGSTFQKALLISPHRFGETRGNSAPLIIREPFIACGPKECKHFAITHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGRGGIKGGFVHQRMASKIGRWYSRTMSKTDRMGMELYVKYDGDPWTDSDALALSGVMVSMEEPGWYSFGFEIKDKKCDVPCIGIEMVHDGGKKTWHSAATTIYCLMGSGQLLWDTVTGVDMAL

SEQ ID NO: 28680 - protein, 466 aa, Artificial Sequence
  neuraminidase__InfluenzaB__ABL77347
MLPSTIQTLTLFLTSGGVLLSLYVSASLSYLLYSDILLKFSPTKITAPTMPLDCANASNVQAVNHSATKGVTLLLPEPEWTYPRLSCPGSTFQKALLISPHRFGETRGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGDCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKKTWHSAATAIYCLMGSGQLLWDTVTGVDMAL

SEQ ID NO: 28681 - protein, 465 aa, Artificial Sequence
  neuraminidase__InfluenzaB__ABL77380
MLPSTIQTLTLFLTSGGVLLSLYVSALLSYLLYSDILLKFSPKIIAPTTSLDCANASNVQAVNHSATKEMKFLPPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGSGGVKGGFVHQRMASKIGRWYSRTMSKTKRMGMELYVKYDGDPWTDSDALAPSGVMVSMEEPGWYSFGFEIKDKKCDVPCIGIEMVHDGGKRTWHSAATAIYCLMGSGQLLWDTVTGVNMAL

SEQ ID NO: 28682 - protein, 466 aa, Artificial Sequence
  neuraminidase__InfluenzaB__ABL77391
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 28683 - protein, 466 aa, Artificial Sequence
  neuraminidase__InfluenzaB__ABL84344
MLPSTIQTLTLFLTSGGVLLSLYVSASLSYLLYSDILLKFSSTEITAPTMPLNCANASNVQAVNHSATKGVTLPLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGDCYLMITDGSASGVSECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWIDSDALTLSGVMVSMEEPGWYSFGFEIKDKKCDVPCIGIEMVHDGGKETWHSAATAIYCLMGSGQLLWDTVTGVDMAL

SEQ ID NO: 28684 - protein, 466 aa, Artificial Sequence
  neuraminidase__InfluenzaB__ABN50397
MLPSTIQTLTLFLTSGGVLLSLYVSASLSYLLYSDILLKFSPTEITAPTMPLNCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGDCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWIDSDALTLSGVMVSMEEPGWYSFGFEIKDKKCDVPCIGIEMVHDGGKKTWHSAATAIYCLMGSGQLLWDTVTGVDMDL

SEQ ID NO: 28685 - protein, 466 aa, Artificial Sequence
  neuraminidase__InfluenzaB__ABN50408
MLPSTIQTLTLFLTSGGVLLSLYVSASLSYLLYSDILLKFSPTEITAPTMPLNCANASNVQAVNRSATKGVTLPLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGDCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWIDSDALTLSGVMVSMEEPGWYSFGFEIKDKKCDVPCIGIEMVHDGGKKTWHSAATAIYCLMGSGQLLWDTVTGVDMAL

SEQ ID NO: 28686 - protein, 466 aa, Artificial Sequence
  neuraminidase__InfluenzaB__ABN50419
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGLCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 28687 - protein, 466 aa, Artificial Sequence
  neuraminidase__InfluenzaB__ABN50430
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 28688 - protein, 466 aa, Artificial Sequence; identical to SEQ ID NO: 28670
  neuraminidase__InfluenzaB__ABN50463

SEQ ID NO: 28689 - protein, 466 aa, Artificial Sequence; identical to SEQ ID NO: 28584
  neuraminidase__InfluenzaB__ABN50474

SEQ ID NO: 28690 - protein, 466 aa, Artificial Sequence
  neuraminidase__InfluenzaB__ABN50485
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCEFNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 28691 - protein, 466 aa, Artificial Sequence
  neuraminidase__InfluenzaB__ABN50496
MLPSTIQTLTLFLTSGGVLLSLYVSASLSYLLYSDILLKFPSTEITAPTMPLDCANASNVQAVNRSATKRVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALAFSGVMVSMEEPGWYSFGFEIKDKKCDVPCIGIEMVHDGGKETWHSAATAIYCLMGSGQLLWDTVTGVNMAL

SEQ ID NO: 28692 - protein, 466 aa, Artificial Sequence
  neuraminidase__InfluenzaB__ABN50507
MLPSTIQTLTLFLTSGGVLLSLYVSASLSYLLYSDILLKFSPTEITAPTMPLNCANASNVQAVNRSATKGVTLPLPEPEWTYPRLSCPGSTFQKALLISPHRFGETKGNSAPLIIREPFIACGPKECRHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGDCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWIDSDALTLSGVMVSMEEPGWYSFGFEIKDKKCDVPCIGIEMVHDGGKKTWHSAATAIYCLMGSGQLLWDTVTGVDMAL

SEQ ID NO: 28693 - protein, 466 aa, Artificial Sequence; identical to SEQ ID NO: 28591
  neuraminidase__InfluenzaB__ABN50518

SEQ ID NO: 28694 - protein, 466 aa, Artificial Sequence; identical to SEQ ID NO: 28591
  neuraminidase__InfluenzaB__ABN50529

SEQ ID NO: 28695 - protein, 466 aa, Artificial Sequence; identical to SEQ ID NO: 28584
  neuraminidase__InfluenzaB__ABN50540

SEQ ID NO: 28696 - protein, 466 aa, Artificial Sequence; identical to SEQ ID NO: 28616
  neuraminidase__InfluenzaB__ABN50551

SEQ ID NO: 28697 - protein, 466 aa, Artificial Sequence
  neuraminidase__InfluenzaB__ABN50562
MLPSTIQTLTLFLTSGGALLSLYVSALLSYLLYSDILLKFSPTKVIAPTMSLDYTNASNVQAVNHSATEEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISRCRFLKIREGRIIKEIFPTGRVEHTEECTCGFASNKTIECACRDNSYTAKRPFVKLNVETDTAEIRLMCTETYLDTPRPDDGSITGPCESNGDKGNGGIKGGFVHQRMASRIGRWYSRTMSKTKRMGMELYVKYDGDPWTDSDALAPSGVMVSMEEPGWYSFGFEIKDKKCDVPCIGIEMVHDGGKKTWHSAATAIYCLMGSGQLLWDTVTGVDMAL

SEQ ID NO: 28698 - protein, 466 aa, Artificial Sequence; identical to SEQ ID NO: 28687
  neuraminidase__InfluenzaB__ABN50573

SEQ ID NO: 28699 - protein, 466 aa, Artificial Sequence
  neuraminidase__InfluenzaB__ABN50584
MLPSTIQTLTLFLTSGGVLLSLYVSASLSYLLYSDILLKFSPTEITASTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVESDTAEIRLMCTETYLDTPRPDDGSITGPCESNGDKGSGGIKGGFVHQRMASKIGRWYSRTMSKTERMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 28700 - protein, 466 aa, Artificial Sequence; identical to SEQ ID NO: 28584
  neuraminidase__InfluenzaB__ABN50595

SEQ ID NO: 28701 - protein, 465 aa, Artificial Sequence
  neuraminidase__InfluenzaB__ABN50606
MLPSTIQTLTLFLTSGGVLLSLYVSASLSYLLYSDILLRFSSKITAPTMTLDCANASNVQAVNRSATKEMTFLLPEPEWTYPRLSCQGSTFQKALLISPHRFGEARGNSAPLIIREPFIACGPKECKHFALTHYAAQPGGYYNGTREDRNKLRHLISVKLGKIPTVENSIFHMAAWSGSACHDGREWTYIGVDGPDSNALIKIKYGEAYTDTYHSYANNILRTQESACNCIGGDCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESDGDKGRGGIKGGFVHQRMASKIGRWYSRTMSKTERMGMELYVKYDGDPWTDSDALAPSGVMVSMKEPGWYSFGFEIKDKKCDVPCIGIEMVHDGGKKTWHSAATAIYCLMGSGQLLWDTVTGVDMAL

SEQ ID NO: 28702 - protein, 465 aa, Artificial Sequence
  neuraminidase__InfluenzaB__ABN50628
MLPSTIQTLTLFLTSGGVLLSLYVSALLSYLLYSDILLKFSPKIIAPTMSLDCANASNVQAVNHSATKEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGRGGVKGGFVHQRMASKIGRWYSRTMSKTERMGMELYVKYDGDPWTDSDALAPSGVMVSMEEPGWYSFGFEIKDKKCDVPCIGIEMVHDGGKKTWHSAATAIYCLMGSGQLLWDTVTGVDMAL

SEQ ID NO: 28703 - protein, 465 aa, Artificial Sequence
  neuraminidase__InfluenzaB__ABN50639
MLPSTIQTLTLFLTSGGVLLSLYVSALLSYLLYSDILLKFSPKIIAPTMSLDCANASNVQAVNHSATKEMTFLLPEPEWTYPRLSCQGSTFQKALLISPHRFGEAKGNSAPLIIREPFIACGPKECKHFALTHYAAQPGGYYNGTREDRNKLRHLISVKLGKIPTVENSIFHMAAWSGSACHDGREWTYIGVDGPDSNALVKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGRGGVKGGFVHQRMASKIGRWYSRTMSKTERMGMELYVKYDGDPWTDSDALAPSGVMVSMEEPGWYSFGFEIKDKKCDVPCIGIEMVHDGGKKTWHSAATAIYCLMGSGQLLWDTVTGVDMAL

SEQ ID NO: 28704 - protein, 465 aa, Artificial Sequence
  neuraminidase__InfluenzaB__ABN50650
MLPSTIQTLTLFLTSGGVLLSLYVSALLSYLLYSDVLLKFSPKIIAPTMSLDCANASNVQAVNHSATEEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGHGGIKGGFVHQRMASKIGRWYSRTMSKTKRMGMELYVKYDGDPWTDSDALAPSGVMVSMEEPGWYSFGFEIKDKKCDVPCIGIEMVHDGGKKTWHSAATAIYCLMGSGQLLWDTVTGVDMAL

SEQ ID NO: 28705 - protein, 465 aa, Artificial Sequence
  neuraminidase__InfluenzaB__ABN50661
MLPSTIQTLTLFLTSGGVLLSLYVSALLSYLLYSDVLLKFSPKMIAPTMSLDCANASNVQAVNHSATEEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGHGGIKGGFVHQRMASKIGRWYSRTMSKTKRMGMELYVKYDGDPWTDSDALAPSGVMVSMEEPGWYSFGFEIKDKKCDVPCIGIEMVHDGGKKTWHSAATAIYCLMGSGQLLWDTVTGVDMAL

SEQ ID NO: 28706 - protein, 466 aa, Artificial Sequence
  neuraminidase__InfluenzaB__ABN50683
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETRGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGLGGIKGGFVHQRMASKIGRWYSRTMSKTKRMGMELYVKYDGDPWTDSDALALSGVMVPMEEPGWYSFGFEIKDKKCDVPCIGIEMVHDGGKKTWHSAATAIYCLMGSGQLLWDTVTGVDMAL

SEQ ID NO: 28707 - protein, 466 aa, Artificial Sequence
  neuraminidase__InfluenzaB__ABN50694
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETRGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKKTWHSAATAIYCLMGSGQLLWDTVTGVDMAL

SEQ ID NO: 28708 - protein, 465 aa, Artificial Sequence
  neuraminidase__InfluenzaB__ABN50705
MLPSTIQTLTLFLTLGGVLLSLYVSALLSYLLYSDVLLKFSPKMIAPTMSLDCANASNVQAVNHSATEEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGHGGIKGGFVHQRMASKIGRWYSRTMSKTKRMGMELYVKYDGDPWTDSDALAPSGVMVSMEEPGWYSFGFEIKDKKCDVPCIGIEMVHDGGKKTWHSAATAIYCLMGSGQLLWDTVTGVDMAL

SEQ ID NO: 28709 - protein, 466 aa, Artificial Sequence
  neuraminidase__InfluenzaB__ABN50716
MLPSTIQTLTLFLTSGGVLLSLYVSASLSYLLYSGILLKFSPTEITAPTMPLDCANASNVQAVNRSATKGVTLLLPEPEWTYPRLSCPGSTFQKALLISPHRFGETRGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKKTWHSAATAIYCLMGSGQLLWDTVTGVDMAL

SEQ ID NO: 28710 - protein, 466 aa, Artificial Sequence
  neuraminidase__InfluenzaB__ABN50727
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGDCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKKTWHSAATAIYCLMGSGQLLWDTVTGVDMAL

SEQ ID NO: 28711 - protein, 466 aa, Artificial Sequence; identical to SEQ ID NO: 28653
  neuraminidase__InfluenzaB__ABN50738

SEQ ID NO: 28712 - protein, 466 aa, Artificial Sequence
  neuraminidase__InfluenzaB__ABN50749
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 28713 - protein, 465 aa, Artificial Sequence
  neuraminidase__InfluenzaB__ABN51188
MLPSTIQTLTLFLTSGGVLLSLYVSALLSYLLYSDILLKFSPKIIAPTMLLDCANASNVQAVNHSATKEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGRGGVKGGFVHQRMASKIGRWYSRTMSKTERMGMELYVKYDGDPWTDSDALAPSGVMVSMEEPGWYSFGFEIKDKKCDVPCIGIEMVHDGGKKTWHSAATAIYCLMGSGQLLWDTVTGVDMAL

SEQ ID NO: 28714 - protein, 465 aa, Artificial Sequence; identical to SEQ ID NO: 28702
  neuraminidase__InfluenzaB__ABN51199

SEQ ID NO: 28715 - protein, 466 aa, Artificial Sequence
  neuraminidase__InfluenzaB__ABN58665
MLPSTIQTLTLFLTSGGVLLSLYVSALLSYLLYSDILLKFSPTKIIAPTMSLDCANASNVQAVNHSATEEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGGKGSGGIKGGFVHQRMASKIGRWYSRTMSKTKRMGMELYVKYDGDPWTDSDALAPSGVMVSMEEPGWYSFGFEIKDKKCDVPCIGIEMVHDGGKKTWHSAATAIYCLMGSGQLLWDTVTGVDMAL

SEQ ID NO: 28716 - protein, 466 aa, Artificial Sequence; identical to SEQ ID NO: 28603
  neuraminidase__InfluenzaB__ABN59449

SEQ ID NO: 28717 - protein, 465 aa, Artificial Sequence; identical to SEQ ID NO: 28681
  neuraminidase__InfluenzaB__ABR15999

SEQ ID NO: 28718 - protein, 466 aa, Artificial Sequence; identical to SEQ ID NO: 28710
  neuraminidase__InfluenzaB__ABR16010

SEQ ID NO: 28719 - protein, 466 aa, Artificial Sequence
  neuraminidase__InfluenzaB__ABR16021
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIRKGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28720 - protein, 466 aa, Artificial Sequence; identical to SEQ ID NO: 28635
  neuraminidase__InfluenzaB__ACA64903

SEQ ID NO: 28721 - protein, 466 aa, Artificial Sequence
  neuraminidase__InfluenzaB__ACA64914
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYVGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMDEPGWYSFGFEIKDKKCDVPCIGIEMVHDGGKTTWHSAATAIYCLMGSGQLLWDTVTGVDMAL

SEQ ID NO: 28722 - protein, 466 aa, Artificial Sequence; identical to SEQ ID NO: 28635
  neuraminidase__InfluenzaB__ACA64936

SEQ ID NO: 28723 - protein, 466 aa, Artificial Sequence
  neuraminidase__InfluenzaB__ACA64969
MLPSTIQTLTLFLTSGGVLLSLYVSASLSYLLYSDILLKFSPTEITAPTMPLDCANASNVQAVNRSAAKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28724 - protein, 466 aa, Artificial Sequence
  neuraminidase__InfluenzaB__ACA64980
MLPSTIQTLTLFLTSGGVLLSLYVSASLSYLLYSDILLKFSPTEITAPTMSLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYASKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28725 - protein, 466 aa, Artificial Sequence
  neuraminidase__InfluenzaB__ACA64991
MLPSTIQTLTLFLTSGGVLLSLYVSASLSYLLYSDILLKFSPTEITAPTMPLDCANASNVHAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFGGVMVSMKEPGWYSFGFEIKDKKCDVPCIGIEMVHDGGKETWHSAATAIYCLMGSGQLLWDTVTGVDMAL

SEQ ID NO: 28726 - protein, 466 aa, Artificial Sequence; identical to SEQ ID NO: 28635
  neuraminidase__InfluenzaB__ACA65013

SEQ ID NO: 28727 - protein, 466 aa, Artificial Sequence; identical to SEQ ID NO: 28635
  neuraminidase__InfluenzaB__ACA65024

SEQ ID NO: 28728 - protein, 466 aa, Artificial Sequence
  neuraminidase__InfluenzaB__ACA65035
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYASKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28729 - protein, 466 aa, Artificial Sequence; identical to SEQ ID NO: 28635
  neuraminidase__InfluenzaB__ACA65046

SEQ ID NO: 28730 - protein, 466 aa, Artificial Sequence
  neuraminidase__InfluenzaB__ACA65057
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVEADTAEIRLMCTDTYLDTPRPDDGSITGPCEFNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28731 - protein, 466 aa, Artificial Sequence; identical to SEQ ID NO: 28635
  neuraminidase__InfluenzaB__ACA65068

SEQ ID NO: 28732 - protein, 466 aa, Artificial Sequence; identical to SEQ ID NO: 28635
  neuraminidase__InfluenzaB__ACA65079

SEQ ID NO: 28733 - protein, 466 aa, Artificial Sequence; identical to SEQ ID NO: 28635
  neuraminidase__InfluenzaB__ACA65090

SEQ ID NO: 28734 - protein, 466 aa, Artificial Sequence; identical to SEQ ID NO: 28635
  neuraminidase__InfluenzaB__ACA65101

SEQ ID NO: 28735 - protein, 466 aa, Artificial Sequence
  neuraminidase__InfluenzaB__ACA96567
MLPSTIQTLTLFLTSGGVLLSLYVSASLSYLLYSDILLKFSPTEITAPTMPLDCANASNVHAVNRSATKGVTLLLPEPEWAYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGIMVSMKEPGWYSFGFEIKDKKCDVPCIGIEMVHDGGKETWHSAATAIYCLMGSGQLLWDTVTGVDMAL

SEQ ID NO: 28736 - protein, 466 aa, Artificial Sequence; identical to SEQ ID NO: 28635
  neuraminidase__InfluenzaB__ACA96578

SEQ ID NO: 28737 - protein, 466 aa, Artificial Sequence; identical to SEQ ID NO: 28723
  neuraminidase__InfluenzaB__ACA96589

SEQ ID NO: 28738 - protein, 466 aa, Artificial Sequence; identical to SEQ ID NO: 28635
  neuraminidase__InfluenzaB__ACA96600

SEQ ID NO: 28739 - protein, 466 aa, Artificial Sequence
  neuraminidase__InfluenzaB__ACA96611
MLPSTIQTLTLFLTSGGVLLSLYVSASLSYLLYSDILLKFSPTEITAPTMPLDYANASNVHAVNHSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGRLLWDTVTGVDMAL

SEQ ID NO: 28740 - protein, 466 aa, Artificial Sequence
  neuraminidase__InfluenzaB__ACA96622
MLPSTIQTLTLFLTSGGVLLSLYVSASLSYLLYSDILLKFSPTEITAPTMPLDCANASNVHAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSIIGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28741 - protein, 466 aa, Artificial Sequence; identical to SEQ ID NO: 28723
  neuraminidase__InfluenzaB__ACA96633

SEQ ID NO: 28742 - protein, 466 aa, Artificial Sequence
  neuraminidase__InfluenzaB__ACA96644
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISIKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMISMKEPGWYSFGFEIKDKKCDVPCIGIEMVHDGGKETWHSAATAIYCLMGSGQLLWDTVTGVDMAL

SEQ ID NO: 28743 - protein, 466 aa, Artificial Sequence
  neuraminidase__InfluenzaB__ACA96655
MLPSTIQTLTLFLTSGGVLLSLYVSASLSYLLYSDILLKFSQTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 28744 - protein, 466 aa, Artificial Sequence
  neuraminidase__InfluenzaB__ACA96666
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTREDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDRGSGGIKGGFVHQRMASKIGRWYSRTMSKTERMGMGLYVKYDGDPWADSDALAFSGVMVSMKEPGWYSFGFEIKDKKCDVPCIGIEMVHDDGKETWHSAATAIYCLMGSGQLLWDTVTGVDMAL

SEQ ID NO: 28745 - protein, 466 aa, Artificial Sequence
  neuraminidase__InfluenzaB__ACD56581
MLPSTIQTLTLFLTSGGVLLSLYVSASLSYLLYSDILLKFSTTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGNKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 28746 - protein, 466 aa, Artificial Sequence
  neuraminidase__InfluenzaB__ACF33793
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDIPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28747 - protein, 466 aa, Artificial Sequence
  neuraminidase__InfluenzaB__ACF33795
MLPSTIQTLTLFLTSGGVLLSLYVSASLSYLLYSDILLKFPSTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTEKMGMGLYVKYDGEPWADSDALTFSGVMVSMEEPGWYSFGFEIKDKKCDVPCIGIEMVHDGGKETWHSAATAIYCLMGSGQLLWDTVTGVNMAL

SEQ ID NO: 28748 - protein, 466 aa, Artificial Sequence
  neuraminidase__InfluenzaB__ACF33797
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNTLRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALALIGVMVSMEEPGWYSFGFEIKDKKCDVPCIGIEMVHDGGKETWHSAATAIYCLMGSGQLLWDTVTGVNMAL

SEQ ID NO: 28749 - protein, 466 aa, Artificial Sequence; identical to SEQ ID NO: 28728
  neuraminidase__InfluenzaB__ACF41662

SEQ ID NO: 28750 - protein, 466 aa, Artificial Sequence
  neuraminidase__InfluenzaB__ACF54140
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTKGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDRGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28751 - protein, 466 aa, Artificial Sequence
  neuraminidase__InfluenzaB__ACF54151
MLPSTIQTLTLFLTSGGVLLSLYVSASLSYLLYSDILLKFPSTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGNRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALAFSGVMVSMEEPGWYSFGFEIKDKKCDVPCIGIEMVHDGGKETWHSAATAIYCLMGSGQLLWDTVTGVNMAL

SEQ ID NO: 28752 - protein, 466 aa, Artificial Sequence
  neuraminidase__InfluenzaB__ACF54162
MLPSTIQTLTLFLTSGGVLLSLYVSASLSYLLYSDILLKFSQTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNNYTAKRPFVKLNVETDTAEIRLMCTETYLDTPRPNDGSITGPCESDGDKGSGGIKGGFVHQRMASKIGRWYSRTMSKTKRMGMELYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 28753 - protein, 466 aa, Artificial Sequence
  neuraminidase__InfluenzaB__ACF54184
MLPSTIQTLTLFLTSGGVLLSLYVSASLSYLLYSDILLKFSTTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTKEDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGNKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 28754 - protein, 466 aa, Artificial Sequence
  neuraminidase__InfluenzaB__ACF54206
MLPSTIQTLTLFLTSGGVLLSLYVSASLSYLLYSDILLKFSTTETTAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGNKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 28755 - protein, 466 aa, Artificial Sequence
  neuraminidase__InfluenzaB__ACF54217
MLPSTIQTLTLFLTSGGVLLSLYVSASLSYLLYSDILLKFSQTEITAPIMPLDCANASNVQAVNHSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 28756 - protein, 466 aa, Artificial Sequence; identical to SEQ ID NO: 28647
  neuraminidase__InfluenzaB__ACF54228

SEQ ID NO: 28757 - protein, 466 aa, Artificial Sequence; identical to SEQ ID NO: 28668
  neuraminidase__InfluenzaB__ACF54239

SEQ ID NO: 28758 - protein, 466 aa, Artificial Sequence
  neuraminidase__InfluenzaB__ACF54261
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLVSVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 28759 - protein, 466 aa, Artificial Sequence
  neuraminidase__InfluenzaB__ACF54272
MLPSTIQTLTLFLTSGGVLLSLYVSASLSYLLYSDILLKFSTTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 28760 - protein, 466 aa, Artificial Sequence
  neuraminidase__InfluenzaB__ACF54283
MLPSTIQTLTLFLTSGGVLLSLYVSASLSYLLYSDILLKFSTTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLVSVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 28761 - protein, 466 aa, Artificial Sequence
  neuraminidase__InfluenzaB__ACF54294
MLPSTIQTLTLFLTSGGVLLSLYVSASLSYLLYSDILLKFSTTEITAPTIPLDCANASNVQAVNRSATKGVTFLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGNKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 28762 - protein, 466 aa, Artificial Sequence
  neuraminidase__InfluenzaB__ACF54305
MLPSTIQTLTLFLTSGGVLLSLYVSASLSYLLYSDILLKFSTTEITAPTMPLDCANASNVQAVNRSATKGVTFLLPEPEWTYPRLSCPGSTFQKALLISPHRFGETKGNSAPLIIREPFIACGPKECKHFALTHYAAQPGGYYNGTREDRNKLRHLISVELGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGNKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 28763 - protein, 466 aa, Artificial Sequence
  neuraminidase__InfluenzaB__ACF54316
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALALIGVMVSMEEPGWYSFGFEIKDKNCDVPCIGIEMVHDGGKETWHSAATAIYCLMGSGQLLWDTVTGVNMAL

SEQ ID NO: 28764 - protein, 467 aa, Artificial Sequence
  neuraminidase__InfluenzaB__ACF54338
MLPSTIQTLTLFLTSGGVLLSLYVSASLSYLLYSDILLKFPSTEITAPTMPLDCANASNVQAVNRSATKGVTLLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGGKGSGGIKGGFVHQRMASKIGRWYSRTMSKTERKGMGLYVKYDGDPWADSDALVFSGVMVSMEEPGWYSFGFEIKDKKCDVPCIGIEMVHDGGKETWHSAATAIYCLMGSGQLLWDTVTGVNMAL

SEQ ID NO: 28765 - protein, 466 aa, Artificial Sequence
  neuraminidase__InfluenzaB__ACF54349
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLINPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGSASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 28766 - protein, 466 aa, Artificial Sequence
  neuraminidase__InfluenzaB__ACF54371
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLTGSGQLLWDTVTGVDMAL

SEQ ID NO: 28767 - protein, 466 aa, Artificial Sequence
  neuraminidase__InfluenzaB__ACI22549
MLPSTIQTLTLFLTSGGVLLSLYVSASLSYLLYSDILLKFSPTEITARTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVEDSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALALIGVMVSMEEPGWYSFGFEIKDKNCDVPCIGIEMVHDGGKETWHSAATAIYCLMGSGQLLWDTVTGVNMAL

SEQ ID NO: 28768 - protein, 466 aa, Artificial Sequence
  neuraminidase__InfluenzaB__ACI22551
MLPSTIQTLTLFLTSGGVLLSLYVSASLSYLLYSDILLKFSPTEITALTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALALIGVMVSMEEPGWYSFGFEIKDKNCDVPCIGIEMVHDGGKETWHSAATAIYCLMGSGQLLWDTVTGVNMAL

SEQ ID NO: 28769 - protein, 466 aa, Artificial Sequence; identical to SEQ ID NO: 28768
  neuraminidase__InfluenzaB__ACI22555

SEQ ID NO: 28770 - protein, 466 aa, Artificial Sequence; identical to SEQ ID NO: 28635
  neuraminidase__InfluenzaB__ACI22557

SEQ ID NO: 28771 - protein, 466 aa, Artificial Sequence
  neuraminidase__InfluenzaB__ACI22559
MLPSTIQTLTLFLTSGGVLLSLYVSASLSYLLYSDILLKFPSTEITAPTMPLDCANASNVQAVNLSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGGKGSGGIKGGFVHQRMASKIGRWYSRTMSKTERKGMGLYVKYDGDPWADSDALAFSGVMVSMEEPGWYSFGFEIKDKKCDVPCIGIEMVHDGGKETWHSAATAIYCLMGSGQLLWDTVTGVNMAL

SEQ ID NO: 28772 - protein, 466 aa, Artificial Sequence
  neuraminidase__InfluenzaB__ACI22561
MLPSTIQTLTLFLTSGGVLLSLYVSASLSYLLYSDILLKFSPTEITAPTMPLDCANASNVQAVNRSATKGGTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28773 - protein, 466 aa, Artificial Sequence; identical to SEQ ID NO: 28635
  neuraminidase__InfluenzaB__ACI22563

SEQ ID NO: 28774 - protein, 466 aa, Artificial Sequence
  neuraminidase__InfluenzaB__ACI22565
MLPSTIQTLTLFLTSGGVLLSLYVSASLSYLLYSDILLKFPSTEITAPTMPLDCANASNVQAVNHSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGGKGSGGIKGGFVHQRMASKIGRWYSRTMSKIERKGMGLYVKYDGDPWADSDALAFSGVMVSMEEPGWYSFGFEIRDKKCDVPCIGIEMVHDGGKETWHSAATAIYCLMGSGQLLWDTVTGVNMAL

SEQ ID NO: 28775 - protein, 466 aa, Artificial Sequence; identical to SEQ ID NO: 28635
  neuraminidase__InfluenzaB__ACI22567

SEQ ID NO: 28776 - protein, 466 aa, Artificial Sequence; identical to SEQ ID NO: 28635
  neuraminidase__InfluenzaB__ACI22569

SEQ ID NO: 28777 - protein, 466 aa, Artificial Sequence
  neuraminidase__InfluenzaB__ACJ53908
MLHSTIQTLTLFLTSGGVLLSLYVSASLSYLLYSDILLKFSQTEITAPIMPLDCANASSVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 28778 - protein, 466 aa, Artificial Sequence; identical to SEQ ID NO: 28653
  neuraminidase__InfluenzaB__ACN32560

SEQ ID NO: 28779 - protein, 466 aa, Artificial Sequence; identical to SEQ ID NO: 28723
  neuraminidase__InfluenzaB__ACN32582

SEQ ID NO: 28780 - protein, 466 aa, Artificial Sequence; identical to SEQ ID NO: 28635
  neuraminidase__InfluenzaB__ACN32593

SEQ ID NO: 28781 - protein, 466 aa, Artificial Sequence
  neuraminidase__InfluenzaB__ACN32604
MLPSTIQTLTLFLTSGGVLLSLYVSASLSYLLYSDILLKFSPTEITAPTMPLDCANASNVHAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCEFNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28782 - protein, 466 aa, Artificial Sequence; identical to SEQ ID NO: 28635
  neuraminidase__InfluenzaB__ACN32615

SEQ ID NO: 28783 - protein, 466 aa, Artificial Sequence
  neuraminidase__InfluenzaB__ACN32775
MLPSTIQTLTLFLTSGGVLLSLYVSASLSYLLYSDILLKFSPTEINAPTMPLDCANASNVHAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKSIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28784 - protein, 466 aa, Artificial Sequence; identical to SEQ ID NO: 28635
  neuraminidase__InfluenzaB__ACN32786

SEQ ID NO: 28785 - protein, 466 aa, Artificial Sequence
  neuraminidase__InfluenzaB__ACO05928
MLPSTIQTLTLFLTSGGVLLSLYVSASLSYLLYSDILLKFPSTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALAFSGVMVPMEEPGWYSFGFEIKDKKCDVPCIGIEMVHDGGKETWHSAATAIYCLMGSGQLLWDTVTGVNMAL

SEQ ID NO: 28786 - protein, 466 aa, Artificial Sequence; identical to SEQ ID NO: 28647
  neuraminidase__InfluenzaB__ACO05950

SEQ ID NO: 28787 - protein, 466 aa, Artificial Sequence
  neuraminidase__InfluenzaB__ACO05961
MLPSTIQTLTLFLTSGGVLLSLYVSASLSYLPYSDILLKFPSTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALAFSGVMVSMEEPGWYSFGFEIKDKKCDVPCIGIEMVHDGGKETWHSAATAIYCLMGSGQLLWDTVTGVNMAL

SEQ ID NO: 28788 - protein, 466 aa, Artificial Sequence
  neuraminidase__InfluenzaB__ACO05972
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 28789 - protein, 466 aa, Artificial Sequence; identical to SEQ ID NO: 28788
  neuraminidase__InfluenzaB__ACO05983

SEQ ID NO: 28790 - protein, 466 aa, Artificial Sequence; identical to SEQ ID NO: 28788
  neuraminidase__InfluenzaB__ACO05994

SEQ ID NO: 28791 - protein, 466 aa, Artificial Sequence
  neuraminidase__InfluenzaB__ACO06005
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDRGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28792 - protein, 466 aa, Artificial Sequence
  neuraminidase__InfluenzaB__ACO06027
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMTL

SEQ ID NO: 28793 - protein, 466 aa, Artificial Sequence
  neuraminidase__InfluenzaB__ACO06066
MLPSTIQTLTLFLTSGGVLLSLYVSASLSYLLYSDILLKFSQTEITAPIMPLDCANASNVQAVNRSVAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMTL

SEQ ID NO: 28794 - protein, 466 aa, Artificial Sequence
  neuraminidase__InfluenzaB__ACO94665
MLPSTIQTLTLFLTSGGVLLSLYVSASLSYLLYSDILLKFSPTEITASTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28795 - protein, 466 aa, Artificial Sequence; identical to SEQ ID NO: 28635
  neuraminidase__InfluenzaB__ACQ45607

SEQ ID NO: 28796 - protein, 466 aa, Artificial Sequence
  neuraminidase__InfluenzaB__ACQ45610
MLPSTIQTLTLFLTSGGVLLSLYVSASLSYLLYSDILLKFSPTEITAPTVPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKYTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28797 - protein, 466 aa, Artificial Sequence; identical to SEQ ID NO: 28635
  neuraminidase__InfluenzaB__ACQ45613

SEQ ID NO: 28798 - protein, 466 aa, Artificial Sequence; identical to SEQ ID NO: 28791
  neuraminidase__InfluenzaB__ACR15626

SEQ ID NO: 28799 - protein, 466 aa, Artificial Sequence; identical to SEQ ID NO: 28791
  neuraminidase__InfluenzaB__ACR15637

SEQ ID NO: 28800 - protein, 466 aa, Artificial Sequence; identical to SEQ ID NO: 28762
  neuraminidase__InfluenzaB__ACR15648

SEQ ID NO: 28801 - protein, 466 aa, Artificial Sequence; identical to SEQ ID NO: 28791
  neuraminidase__InfluenzaB__ACR15659

SEQ ID NO: 28802 - protein, 466 aa, Artificial Sequence; identical to SEQ ID NO: 28791
  neuraminidase__InfluenzaB__ACR15670

SEQ ID NO: 28803 - protein, 466 aa, Artificial Sequence; identical to SEQ ID NO: 28616
  neuraminidase__InfluenzaB__ACR15681

SEQ ID NO: 28804 - protein, 466 aa, Artificial Sequence
  neuraminidase__InfluenzaB__ACR15692
MLPSTIQTLTLFLTSGGVLLSLYVSASLSYLLYSDILLKFSPTEITAPTMPLGCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADNDALALSGVMVSMEEPGWYSFGFEIKDKKCDVPCIGIEMVHDGGKETWHSAATAIYCLMGSGQLLWDTVTGVDMAL

SEQ ID NO: 28805 - protein, 466 aa, Artificial Sequence; identical to SEQ ID NO: 28792
  neuraminidase__InfluenzaB__ACR15703

SEQ ID NO: 28806 - protein, 466 aa, Artificial Sequence; identical to SEQ ID NO: 28792
  neuraminidase__InfluenzaB__ACR15714

SEQ ID NO: 28807 - protein, 466 aa, Artificial Sequence; identical to SEQ ID NO: 28707
  neuraminidase__InfluenzaB__ACR15725

SEQ ID NO: 28808 - protein, 466 aa, Artificial Sequence; identical to SEQ ID NO: 28668
  neuraminidase__InfluenzaB__ACR15736

SEQ ID NO: 28809 - protein, 466 aa, Artificial Sequence; identical to SEQ ID NO: 28791
  neuraminidase__InfluenzaB__ACR39340

SEQ ID NO: 28810 - protein, 466 aa, Artificial Sequence
  neuraminidase__InfluenzaB__ADL28399
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKIIECACRDSSYTAKRPFVKLNVETDTAEIRLMCTETYLDTPRPNDGSITGPCESNGDKGSGGIKGGFVHQRMASKIGRWYSRTMSKTERMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 28811 - protein, 466 aa, Artificial Sequence; identical to SEQ ID NO: 28788
  neuraminidase__InfluenzaB__ADN32822

SEQ ID NO: 28812 - protein, 466 aa, Artificial Sequence
  neuraminidase__InfluenzaB__ADR02756
MLPSTIQTLTLFLTSGGVLLSLYVSASLSYLLYSDILLKFSQTEITAPIIPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 28813 - protein, 466 aa, Artificial Sequence
  neuraminidase__InfluenzaB__AEA51353
MLPSTIQTLTLFLTSGGVLLSLYVSASLSYLLYSDILLKFSRTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGGAFTDTYHSYAKNILSPQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 28814 - protein, 466 aa, Artificial Sequence
  neuraminidase__InfluenzaB__AEA51355
MLPSTIQTLTLFLTSGGVLLSLYVSASLSYLLYSDILLKFSPTEITAPTMPLDCANTSNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKITYGEAYPGTYHSYAIKNPRTQESAPNCFGGHSFPIITHAPPSGVWEPRFLKIREGRIINEIFPTGRVKPPEECTCGFASNNTIECACRDNNCTAKRPFVKFHVESDPAEIRAMCTDTYLDSPRPDDGSITGPCDSNGDKGSGGIKGGFVHQRMESKIGRWYSRTMSKTERMGMGLYVKYDGDPWADSDALANSGVMVSMNEPGSSSFGFEIKDKKCDVPCIGIEMVHDGGKETWHSAATAIYCLMGSGQLLWDTVTGVDMAL

SEQ ID NO: 28815 - protein, 466 aa, Artificial Sequence
  neuraminidase__InfluenzaB__AEA51357
MLPSTIQTLTLFLTSGGVLLSLYVSASLSYLLYSDILLKFSRTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKFGEAYTDTYHSYAKNILGTQESACNCIGGDCNLMITDGPASGISESRFLKIGEGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVNMAL

SEQ ID NO: 28816 - protein, 466 aa, Artificial Sequence
  neuraminidase__InfluenzaB__AEA51359
MLPSTIQTLTLFLTSGGVLLSLYVSASLSYLLYSDILLKFSRTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 28817 - protein, 466 aa, Artificial Sequence
  neuraminidase__InfluenzaB__AEA51365
MLPSTIQTLTLFLTSGGVLLSLYVSASLSYLLYSDILLKFSRTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 28818 - protein, 466 aa, Artificial Sequence; identical to SEQ ID NO: 28817
  neuraminidase__InfluenzaB__AEA51367

SEQ ID NO: 28819 - protein, 466 aa, Artificial Sequence; identical to SEQ ID NO: 28817
  neuraminidase__InfluenzaB__AEA51371

SEQ ID NO: 28820 - protein, 466 aa, Artificial Sequence
  neuraminidase__InfluenzaB__AEA51373
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKETWHSAATAIYCLMGSGQLLWDTVTGVNMTL

SEQ ID NO: 28821 - protein, 466 aa, Artificial Sequence
  neuraminidase__InfluenzaB__AEA51377
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28822 - protein, 466 aa, Artificial Sequence; identical to SEQ ID NO: 28821
  neuraminidase__InfluenzaB__AEA51379

SEQ ID NO: 28823 - protein, 466 aa, Artificial Sequence
  neuraminidase__InfluenzaB__AEA51381
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSVKEPGWYSFGFEIKDKKCDVPCIGIEMVHDGGKETWHSAATAIYCLMGSGQLLWDTVTGVDMAL

SEQ ID NO: 28824 - protein, 466 aa, Artificial Sequence; identical to SEQ ID NO: 28821
  neuraminidase__InfluenzaB__AEA51383

SEQ ID NO: 28825 - protein, 466 aa, Artificial Sequence
  neuraminidase__InfluenzaB__AEG20998
MLPSTIQTLTLFLTSGGVLLSLYVSASLSYLLYSDILLKFSRTEITAPILRLACANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGGAFTDTYHSYAKNILSPQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 28826 - protein, 466 aa, Artificial Sequence
  neuraminidase__InfluenzaB__AEG20999
MLPSTIQTLTLFLTSGGVLLSLSVSASLSYLLYSDILLKFSRTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGGAFTDTYHSYAKNILSPQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 28827 - protein, 466 aa, Artificial Sequence
  neuraminidase__InfluenzaB__AEG21000
MLPSTIQTLTLFLTSGGVLLSLYVSASLSYLLYSDILLKFSRTEITAAILILDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGGAFTDTYHSYAKNILSPQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 28828 - protein, 466 aa, Artificial Sequence
  neuraminidase__InfluenzaB__AEG21002
MLPSTIQTLTLFLTSGGVLLSLYVSASLSYLLYSDILLKFSRTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVRHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 28829 - protein, 466 aa, Artificial Sequence
  neuraminidase__InfluenzaB__AEG21003
MLPSTIQTLTLFLTSGGVLLSLYVSASLSYLLYSDILLKFSRTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 28830 - protein, 466 aa, Artificial Sequence
  neuraminidase__InfluenzaB__AEG21004
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGGGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28831 - protein, 466 aa, Artificial Sequence
  neuraminidase__InfluenzaB__AEG21005
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGGGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVNMTL

SEQ ID NO: 28832 - protein, 466 aa, Artificial Sequence; identical to SEQ ID NO: 28817
  neuraminidase__InfluenzaB__AEG21006

SEQ ID NO: 28833 - protein, 466 aa, Artificial Sequence; identical to SEQ ID NO: 28821
  neuraminidase__InfluenzaB__AEG21007

SEQ ID NO: 28834 - protein, 466 aa, Artificial Sequence
  neuraminidase__InfluenzaB__AEG21008
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTKRMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28835 - protein, 466 aa, Artificial Sequence; identical to SEQ ID NO: 28821
  neuraminidase__InfluenzaB__AEG21009

SEQ ID NO: 28836 - protein, 466 aa, Artificial Sequence; identical to SEQ ID NO: 28821
  neuraminidase__InfluenzaB__AEG21010

SEQ ID NO: 28837 - protein, 466 aa, Artificial Sequence; identical to SEQ ID NO: 28821
  neuraminidase__InfluenzaB__AEG21011

SEQ ID NO: 28838 - protein, 466 aa, Artificial Sequence; identical to SEQ ID NO: 28821
  neuraminidase__InfluenzaB__AEG21012

SEQ ID NO: 28839 - protein, 466 aa, Artificial Sequence
  neuraminidase__InfluenzaB__AEG21013
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28840 - protein, 466 aa, Artificial Sequence
  neuraminidase__InfluenzaB__AEN68957
MLPSTIQTLTLFLTSGGVLLSLYVSASLSYLLYSDILLKFSRTEIPAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKMRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKYTEECTCGFASNKTIGCACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLMWDTVTGVNMTL

SEQ ID NO: 28841 - protein, 466 aa, Artificial Sequence
  neuraminidase__InfluenzaB__AEO80071
MLPSTIQTLTLFLTSGGVLLSLYVSASLSYLLYSDILLKFSPTEITAPTMPLDCANASNVHAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28842 - protein, 466 aa, Artificial Sequence
  neuraminidase__InfluenzaB__AEO80082
MLPSTIQTLTLFLTSGGVLLSLYVSASLSYLLYSDILLKFSQTGITAPIMPLDCANASNVQAVNRSATKGVTLLLPEPEWTYPRLSCPGSTFQKALLISPHRFGETKGNSAPLIIREPFIACGPTECKYFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 28843 - protein, 466 aa, Artificial Sequence; identical to SEQ ID NO: 28682
  neuraminidase__InfluenzaB__AEO80090

SEQ ID NO: 28844 - protein, 466 aa, Artificial Sequence; identical to SEQ ID NO: 28627
  neuraminidase__InfluenzaB__AEO80101

SEQ ID NO: 28845 - protein, 466 aa, Artificial Sequence; identical to SEQ ID NO: 28723
  neuraminidase__InfluenzaB__AEO80149

SEQ ID NO: 28846 - protein, 466 aa, Artificial Sequence; identical to SEQ ID NO: 28635
  neuraminidase__InfluenzaB__AEO80158

SEQ ID NO: 28847 - protein, 466 aa, Artificial Sequence; identical to SEQ ID NO: 28635
  neuraminidase__InfluenzaB__AEO80167

SEQ ID NO: 28848 - protein, 466 aa, Artificial Sequence; identical to SEQ ID NO: 28723
  neuraminidase__InfluenzaB__AEO80176

SEQ ID NO: 28849 - protein, 466 aa, Artificial Sequence
  neuraminidase__InfluenzaB__AEO80187
MLPSTIQTLTLFLTSGGVLLSLYVSASLSYLLYSDILLKFSPTEITAPTMPLGCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDRGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28850 - protein, 466 aa, Artificial Sequence
  neuraminidase__InfluenzaB__AEO80198
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDRGSGGIKGGFVHQRMASKIGRWYSRTMSKTERMGMGLYVKYDGDPWADSDALAFRGVMVSMKEPGWYSFGFEIKDKKCDVPCIGIEMVHDGGKETWHSAATAIYCLMGSGQLLWDTVTGVDMAL

SEQ ID NO: 28851 - protein, 466 aa, Artificial Sequence; identical to SEQ ID NO: 28791
  neuraminidase__InfluenzaB__AEO80209

SEQ ID NO: 28852 - protein, 466 aa, Artificial Sequence
  neuraminidase__InfluenzaB__AEO80220
MLPSTIQTLTLFLTSGGVLLSLYVSASLSYLLYSDILLKFSPTEITAPTMPLDCANASNVQAVNRSATKGLTLLLPEPEWTYPRLSCPGSTFQKALLISPHRFGETKGNSAPLIIREPFIACGPNECKHFALTHYAAQPGGYYNGTRGDRNKLRHLISVKLGKIPTVETSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDRGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28853 - protein, 466 aa, Artificial Sequence; identical to SEQ ID NO: 28788
  neuraminidase__InfluenzaB__AEO80231

SEQ ID NO: 28854 - protein, 466 aa, Artificial Sequence; identical to SEQ ID NO: 28791
  neuraminidase__InfluenzaB__AEO80242

SEQ ID NO: 28855 - protein, 466 aa, Artificial Sequence; identical to SEQ ID NO: 28635
  neuraminidase__InfluenzaB__AEP20182

SEQ ID NO: 28856 - protein, 466 aa, Artificial Sequence
  neuraminidase__InfluenzaB__AEP20193
MLPSTIQTLTLFLTSGGVLLSLYVSASLSYLLYSDILLKFSPTEITAPTMPLDCANASNVHAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSVKEPGWYSFGFEIKDKKCDVPCIGIEMVHDGGKETWHSAATAIYCLMGSGQLLWDTVTGVDMAL

SEQ ID NO: 28857 - protein, 466 aa, Artificial Sequence
  neuraminidase__InfluenzaB__AEP20204
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSIKEPGWYSFGFEIKDKKCDVPCIGIEMVHDGGKETWHSAATAIYCLMGSGQLLWDTVTGVDMAL

SEQ ID NO: 28858 - protein, 466 aa, Artificial Sequence; identical to SEQ ID NO: 28687
  neuraminidase__InfluenzaB__AEP20215

SEQ ID NO: 28859 - protein, 466 aa, Artificial Sequence
  neuraminidase__InfluenzaB__AEP20237
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDAAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 28860 - protein, 466 aa, Artificial Sequence; identical to SEQ ID NO: 28687
  neuraminidase__InfluenzaB__AEP20248

SEQ ID NO: 28861 - protein, 466 aa, Artificial Sequence
  neuraminidase__InfluenzaB__AEP20259
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKIIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 28862 - protein, 466 aa, Artificial Sequence
  neuraminidase__InfluenzaB__AEP20281
MLPSTIQTLTLFLTSGGVLLSLYVSASLSYLLYSDILLKFSPTEITAPTMPLDCANASNVQAVNRSTTKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 28863 - protein, 466 aa, Artificial Sequence; identical to SEQ ID NO: 28635
  neuraminidase__InfluenzaB__AEP20292

SEQ ID NO: 28864 - protein, 466 aa, Artificial Sequence; identical to SEQ ID NO: 28627
  neuraminidase__InfluenzaB__AEP20303

SEQ ID NO: 28865 - protein, 466 aa, Artificial Sequence
  neuraminidase__InfluenzaB__AEP20314
MLPSTIQTLTLFLTSGGVLLSLYVSASLSYLLYSDILLKFSQTGITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMISMEEPGWYSFGFEIKDKKCDVPCIGIEMVHDGGKTTWHSAATAIYCLMGSGQLLWDTVTGVDMAL

SEQ ID NO: 28866 - protein, 466 aa, Artificial Sequence
  neuraminidase__InfluenzaB__AEP20336
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALTLSGVMVSMEEPGWYSFGFEIKDKKCDVPCIGIEMVHDGGKETWHSAATSIYCLMGSGQLLWDTVTGVDMAL

SEQ ID NO: 28867 - protein, 466 aa, Artificial Sequence
  neuraminidase__InfluenzaB__AEP20347
MLPSTIQTLTLFLTSGGVLLSLYVSASLSYLLYSDILLKFSQTEITAPIMPLDCANASNVQAVNRSATKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVPMEEPGWYSFGFEIKDKKCDVPCIGIEMVHDGGKTTWHSAATAIYCLMGSGQLLWDTVTGVDMAL

SEQ ID NO: 28868 - protein, 466 aa, Artificial Sequence; identical to SEQ ID NO: 28867
  neuraminidase__InfluenzaB__AEP20358

SEQ ID NO: 28869 - protein, 466 aa, Artificial Sequence; identical to SEQ ID NO: 28867
  neuraminidase__InfluenzaB__AEP20369

SEQ ID NO: 28870 - protein, 466 aa, Artificial Sequence; identical to SEQ ID NO: 28867
  neuraminidase__InfluenzaB__AEP20380

SEQ ID NO: 28871 - protein, 466 aa, Artificial Sequence
  neuraminidase__InfluenzaB__AEP20391
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNRLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKVGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28872 - protein, 466 aa, Artificial Sequence
  neuraminidase__InfluenzaB__AEP20413
MLPSTIQTLTLFLTSGGVLLSLYVSALLSYLLYSDILLKFSPTEIIAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYNGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28873 - protein, 466 aa, Artificial Sequence; identical to SEQ ID NO: 28872
  neuraminidase__InfluenzaB__AEP20435

SEQ ID NO: 28874 - protein, 466 aa, Artificial Sequence; identical to SEQ ID NO: 28867
  neuraminidase__InfluenzaB__AEQ39031

SEQ ID NO: 28875 - protein, 466 aa, Artificial Sequence
  neuraminidase__InfluenzaB__AEQ39275
MLPSTIQTLTLFLTSGGVLLSLYVSASLSYLLYSDILLKFSPKEITAPTMPLDCANASNVQAVNHSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28876 - protein, 466 aa, Artificial Sequence; identical to SEQ ID NO: 28875
  neuraminidase__InfluenzaB__AEQ39286

SEQ ID NO: 28877 - protein, 466 aa, Artificial Sequence; identical to SEQ ID NO: 28875
  neuraminidase__InfluenzaB__AEQ39297

SEQ ID NO: 28878 - protein, 466 aa, Artificial Sequence; identical to SEQ ID NO: 28875
  neuraminidase__InfluenzaB__AEQ39308

SEQ ID NO: 28879 - protein, 466 aa, Artificial Sequence; identical to SEQ ID NO: 28875
  neuraminidase__InfluenzaB__AEQ39319

SEQ ID NO: 28880 - protein, 466 aa, Artificial Sequence
  neuraminidase__InfluenzaB__AEQ39330
MLPSTIQTLTLFLTSGGVLLSLYVSASLSYLLYSDILLKFSPKEITAPTMPLDCANASNVQAVNHSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDIAL

SEQ ID NO: 28881 - protein, 466 aa, Artificial Sequence; identical to SEQ ID NO: 28875
  neuraminidase__InfluenzaB__AEQ39341

SEQ ID NO: 28882 - protein, 466 aa, Artificial Sequence; identical to SEQ ID NO: 28875
  neuraminidase__InfluenzaB__AEQ39352

SEQ ID NO: 28883 - protein, 466 aa, Artificial Sequence; identical to SEQ ID NO: 28875
  neuraminidase__InfluenzaB__AEQ39363

SEQ ID NO: 28884 - protein, 466 aa, Artificial Sequence; identical to SEQ ID NO: 28841
  neuraminidase__InfluenzaB__AEQ39374

SEQ ID NO: 28885 - protein, 466 aa, Artificial Sequence
  neuraminidase__InfluenzaB__AEQ39385
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMTSKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 28886 - protein, 466 aa, Artificial Sequence
  neuraminidase__InfluenzaB__AEQ39444
MLPSTIQTLTLFLTSGGVLLSLYVSASLSYLLYSDILLKFSQTEIIAPIMPLDCANASNVQAVNRSATKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 28887 - protein, 466 aa, Artificial Sequence; identical to SEQ ID NO: 28788
  neuraminidase__InfluenzaB__AEQ39455

SEQ ID NO: 28888 - protein, 466 aa, Artificial Sequence
  neuraminidase__InfluenzaB__AEQ39466
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKVGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28889 - protein, 466 aa, Artificial Sequence; identical to SEQ ID NO: 28875
  neuraminidase__InfluenzaB__AEQ39477

SEQ ID NO: 28890 - protein, 466 aa, Artificial Sequence
  neuraminidase__InfluenzaB__AEQ39488
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESNGDKGSGGIKGGFVHQRMESRIGRWYSRTMSKTERMGMGLYVKYDGDPWTDSDALAFSGVMVSMKEPGWYSFGFEIKDKKCDVPCIGIEMVHDGGKETWHSAATAIYCLMGSGQLLWDTVTGVDMAL

SEQ ID NO: 28891 - protein, 466 aa, Artificial Sequence; identical to SEQ ID NO: 28841
  neuraminidase__InfluenzaB__AEQ39499

SEQ ID NO: 28892 - protein, 466 aa, Artificial Sequence; identical to SEQ ID NO: 28687
  neuraminidase__InfluenzaB__AEQ39510

SEQ ID NO: 28893 - protein, 466 aa, Artificial Sequence
  neuraminidase__InfluenzaB__AEQ49685
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMDL

SEQ ID NO: 28894 - protein, 466 aa, Artificial Sequence
  neuraminidase__InfluenzaB__AEQ49686
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28895 - protein, 466 aa, Artificial Sequence
  neuraminidase__InfluenzaB__AEQ49687
MLPSTIQTLTLFLTSGGVLLSLYVSALLSYLLYSDILLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28896 - protein, 466 aa, Artificial Sequence
  neuraminidase__InfluenzaB__AEQ49688
MLPSTIQTLTLFLTSGGVLLSLYVSASLSYLLYSDILLKFSRTEITAPIMPLGCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 28897 - protein, 466 aa, Artificial Sequence
  neuraminidase__InfluenzaB__AEQ49691
MLPSTIQTLTLFLTSGGVLLSLYVSALLSYLLYSDILLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDRGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28898 - protein, 466 aa, Artificial Sequence
  neuraminidase__InfluenzaB__AEQ49692
MLPSTIQTLTLFLTSGGVLLSLYVSASLSYLLYSDILLKFSPTETTAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28899 - protein, 466 aa, Artificial Sequence
  neuraminidase__InfluenzaB__AEQ49693
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNRTIECACRDNSYTAKRPFVKLNVETDTAEIRLMCTDTYLDTPRPNDGSITGPCESDGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28900 - protein, 466 aa, Artificial Sequence
  neuraminidase__InfluenzaB__AEQ49695
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28901 - protein, 466 aa, Artificial Sequence
  neuraminidase__InfluenzaB__AEQ49697
MLPSTIQTLTLFLTSGGVLLSLYVSASLSYLLYSDILLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28902 - protein, 466 aa, Artificial Sequence; identical to SEQ ID NO: 28901
  neuraminidase__InfluenzaB__AEQ49698

SEQ ID NO: 28903 - protein, 466 aa, Artificial Sequence; identical to SEQ ID NO: 28901
  neuraminidase__InfluenzaB__AEQ49699

SEQ ID NO: 28904 - protein, 466 aa, Artificial Sequence; identical to SEQ ID NO: 28901
  neuraminidase__InfluenzaB__AEQ49700

SEQ ID NO: 28905 - protein, 466 aa, Artificial Sequence; identical to SEQ ID NO: 28898
  neuraminidase__InfluenzaB__AEQ49701

SEQ ID NO: 28906 - protein, 466 aa, Artificial Sequence; identical to SEQ ID NO: 28901
  neuraminidase__InfluenzaB__AEQ49702

SEQ ID NO: 28907 - protein, 466 aa, Artificial Sequence; identical to SEQ ID NO: 28898
  neuraminidase__InfluenzaB__AEQ49703

SEQ ID NO: 28908 - protein, 466 aa, Artificial Sequence; identical to SEQ ID NO: 28901
  neuraminidase__InfluenzaB__AEQ49705

SEQ ID NO: 28909 - protein, 466 aa, Artificial Sequence
  neuraminidase__InfluenzaB__AEQ49706
MLPSTIQMLTLFLTLGGVLLSLYVSASLSYLLYLDILLKFPPTEITAPTMPLDCANASNVQAVNRSATKGVTFLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAFTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVNMAL

SEQ ID NO: 28910 - protein, 466 aa, Artificial Sequence; identical to SEQ ID NO: 28901
  neuraminidase__InfluenzaB__AEQ49707

SEQ ID NO: 28911 - protein, 466 aa, Artificial Sequence; identical to SEQ ID NO: 28901
  neuraminidase__InfluenzaB__AEQ49708

SEQ ID NO: 28912 - protein, 466 aa, Artificial Sequence
  neuraminidase__InfluenzaB__AEQ49709
MLPSTIQTLTLFLTSGGVLLSLYVSALLSYLLYSDILLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGHLLWDTVTGVDMAL

SEQ ID NO: 28913 - protein, 466 aa, Artificial Sequence; identical to SEQ ID NO: 28875
  neuraminidase__InfluenzaB__AEQ49710

SEQ ID NO: 28914 - protein, 466 aa, Artificial Sequence; identical to SEQ ID NO: 28872
  neuraminidase__InfluenzaB__AER27042

SEQ ID NO: 28915 - protein, 466 aa, Artificial Sequence; identical to SEQ ID NO: 28900
  neuraminidase__InfluenzaB__AER27053

SEQ ID NO: 28916 - protein, 466 aa, Artificial Sequence; identical to SEQ ID NO: 28872
  neuraminidase__InfluenzaB__AER27064

SEQ ID NO: 28917 - protein, 466 aa, Artificial Sequence; identical to SEQ ID NO: 28875
  neuraminidase__InfluenzaB__AET43128

SEQ ID NO: 28918 - protein, 466 aa, Artificial Sequence; identical to SEQ ID NO: 28875
  neuraminidase__InfluenzaB__AET43139

SEQ ID NO: 28919 - protein, 466 aa, Artificial Sequence
  neuraminidase__InfluenzaB__AET43150
MLPSTIQTLTLFLTSGGVLLSLYVSASLSYLLYSDILLKFSPKEITAPTMPLDCANASNVQAVNHSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALTFSGVMVSMKEPGWYSFGFEIKDKKCDVPCIGIEMVHDGGKETWHSAATAIYCLMGSGQLLWDTVTGVDMAL

SEQ ID NO: 28920 - protein, 466 aa, Artificial Sequence; identical to SEQ ID NO: 28875
  neuraminidase__InfluenzaB__AET43161

SEQ ID NO: 28921 - protein, 466 aa, Artificial Sequence; identical to SEQ ID NO: 28875
  neuraminidase__InfluenzaB__AET43172

SEQ ID NO: 28922 - protein, 466 aa, Artificial Sequence; identical to SEQ ID NO: 28875
  neuraminidase__InfluenzaB__AET43183

SEQ ID NO: 28923 - protein, 466 aa, Artificial Sequence; identical to SEQ ID NO: 28875
  neuraminidase__InfluenzaB__AET43194

SEQ ID NO: 28924 - protein, 466 aa, Artificial Sequence; identical to SEQ ID NO: 28875
  neuraminidase__InfluenzaB__AET43216

SEQ ID NO: 28925 - protein, 466 aa, Artificial Sequence; identical to SEQ ID NO: 28875
  neuraminidase__InfluenzaB__AET43227

SEQ ID NO: 28926 - protein, 466 aa, Artificial Sequence
  neuraminidase__InfluenzaB__AET50947
MLPSTIQTLTLFLTSGGVLLSLYVSASLSYLLYSDILLKFSPKEITAPTMPLDCANASNVQAVNHSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMISMKEPGWYSFGFEIKDKKCDVPCIGIEMVHDGGKETWHSAATAIYCLMGSGQLLWDTVTGVDMAL

SEQ ID NO: 28927 - protein, 466 aa, Artificial Sequence
  neuraminidase__InfluenzaB__AET50958
MLPSTIQTLTLFLTSGGVLLSLYVSASLSYLLYSDILLKFSPKEITAPTMPLDCANASNVQAVNHSATKGVTLLLPELEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28928 - protein, 466 aa, Artificial Sequence; identical to SEQ ID NO: 28875
  neuraminidase__InfluenzaB__AET50969

SEQ ID NO: 28929 - protein, 466 aa, Artificial Sequence; identical to SEQ ID NO: 28875
  neuraminidase__InfluenzaB__AET50980

SEQ ID NO: 28930 - protein, 466 aa, Artificial Sequence; identical to SEQ ID NO: 28875
  neuraminidase__InfluenzaB__AET74259

SEQ ID NO: 28931 - protein, 466 aa, Artificial Sequence; identical to SEQ ID NO: 28875
  neuraminidase__InfluenzaB__AET74270

SEQ ID NO: 28932 - protein, 466 aa, Artificial Sequence; identical to SEQ ID NO: 28926
  neuraminidase__InfluenzaB__AET74281

SEQ ID NO: 28933 - protein, 466 aa, Artificial Sequence; identical to SEQ ID NO: 28875
  neuraminidase__InfluenzaB__AET74292

SEQ ID NO: 28934 - protein, 466 aa, Artificial Sequence; identical to SEQ ID NO: 28875
  neuraminidase__InfluenzaB__AET74303

SEQ ID NO: 28935 - protein, 466 aa, Artificial Sequence; identical to SEQ ID NO: 28875
  neuraminidase__InfluenzaB__AET74314

SEQ ID NO: 28936 - protein, 466 aa, Artificial Sequence; identical to SEQ ID NO: 28875
  neuraminidase__InfluenzaB__AET74333

SEQ ID NO: 28937 - protein, 466 aa, Artificial Sequence
  neuraminidase__InfluenzaB__AET74344
MLPSTIQTLTLFLTSGGVLLSLYVSASLSYLLYSDILLKFSPKEITAPTMPLDCANASNVQAVNHSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVEADTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28938 - protein, 466 aa, Artificial Sequence; identical to SEQ ID NO: 28875
  neuraminidase__InfluenzaB__AET74355

SEQ ID NO: 28939 - protein, 467 aa, Artificial Sequence
  neuraminidase__InfluenzaB__AEY75594
MLPSTIQMLTLFLTSGGVLLSLYVSASLSYLLYSDILLKFSPTEITAPTMPLDCANASNVHAVNRSATKGVTFLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGTKGGFVHQRMASKIGRWYSRTMSKTERKGMGLYVKYDGDPWTDSDALAFRGVMVSMKEPGWYSFGFEIKDKKCDVPCIGIEMVHDGGKETWHSAATAIYCLMGSGQLLWDTVTGVDMAL

SEQ ID NO: 28940 - protein, 466 aa, Artificial Sequence
  neuraminidase__InfluenzaB__AFA45223
MLPSTIQTLTLFLTSGGVLLSLYVSALLSYLLYSDILPKFSPTEITAPTMSLDCANASNVQAVNRSATKGVTFLLSEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28941 - protein, 466 aa, Artificial Sequence
  neuraminidase__InfluenzaB__AFA45226
MLPSTIQTLTLFLTSGGVLLSLYVSASLSYLLYSDILLKFSPTETTAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKVPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKGTWHSAATAIYCLMGSGQLLWDTVTGVDMAL

SEQ ID NO: 28942 - protein, 466 aa, Artificial Sequence
  neuraminidase__InfluenzaB__AFA45229
MLPSTIQTLTLFLTSGGVLLSLYVSALLSYLLYSDILLKFSPTEITAPTMPLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28943 - protein, 466 aa, Artificial Sequence; identical to SEQ ID NO: 28895
  neuraminidase__InfluenzaB__AFA45235

SEQ ID NO: 28944 - protein, 466 aa, Artificial Sequence
  neuraminidase__InfluenzaB__AFA45238
MLPSTIQTLTLFLTSGGVLLSLYVSASLSYLLYSDILLKFSPTKTTAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28945 - protein, 466 aa, Artificial Sequence
  neuraminidase__InfluenzaB__AFA45241
MLPSTIQTLTLFLTSGGVLLSLYVSASLSYLLYSDILLKFSPTEITAPTMPLDCANASNVQAVNRSATKGVIFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALTFSGVMVSMKEPGWYSFGFEIKDKKCDVPCIGIEMVHDGGKETWHSAATAIYCLMGSGQLLWDTVTGVDMAL

SEQ ID NO: 28946 - protein, 466 aa, Artificial Sequence
  neuraminidase__InfluenzaB__AFA45244
MLPSTIQTLTLFLTSGGVLLSLYVSASLSYLLYSDILLKFSPTETTAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKKTWHSAATAIYCLMGSGQLLWDTVTGVDMAL

SEQ ID NO: 28947 - protein, 466 aa, Artificial Sequence
  neuraminidase__InfluenzaB__AFA45247
MLPSTIQTLTLFLTSGGVLLSLYVSASLSYLLYSDILLKFSTTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMVTDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALVFSGVMVSMKEPGWYSFGFEIKDKKCDVPCIGIEMVHDGGKETWHSAATAIYCLMGSGQLLWDTVTGVDMAL

SEQ ID NO: 28948 - protein, 466 aa, Artificial Sequence; identical to SEQ ID NO: 28898
  neuraminidase__InfluenzaB__AFA45250

SEQ ID NO: 28949 - protein, 466 aa, Artificial Sequence
  neuraminidase__InfluenzaB__AFA45253
MLPSTIQTLTLFLTSGGVLLSLYVSALLSYLLYSDILLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECVCRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28950 - protein, 466 aa, Artificial Sequence
  neuraminidase__InfluenzaB__AFB77645
MLPSTIQTLTLFLTSGGVLLSLYVSASLSYLLYSDILLKFSPTEITAPAMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRMESKIGRWYSRTMSKTERMGMGLYVKYDGDPWADSDALVFSGVMVSMKEPGWYSFGFEIKDKKCDVPCIGIEMVHDGGKETWHSAATAIYCLMGSGQLLWDTVTGVDMAL

SEQ ID NO: 28951 - protein, 466 aa, Artificial Sequence
  neuraminidase__InfluenzaB__AFB77647
MLPSTIQTLTLFLTSGGVLLSLYVSASLSYLLYSDILLKFSPTEITAPAIPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28952 - protein, 466 aa, Artificial Sequence
  neuraminidase__InfluenzaB__AFB77649
MLPSTIQTLTLFLTSGGVLLSLYVSASLSYLLYSDILLKFSPTEITAPAMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRIKHTEECTCGFASNKTIECACRDNSYTAKRPFVKLNVETDTAEIRLMCTDTYLDTPRPNDGSITGPCESDGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28953 - protein, 466 aa, Artificial Sequence
  neuraminidase__InfluenzaB__AFB77651
MLPSTIQTLTLFLTSGGVLLSLYVSASLSYLLYSDILLKFSPTEITAPAMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLTSVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28954 - protein, 466 aa, Artificial Sequence
  neuraminidase__InfluenzaB__AFE00364
MLPSTIQMLTLFLTSGGVLLSLYVSASLSYLLYSDILLKFSPTEITAPTMPLDCANASNVHAVNRSATKGVTFLLPEPEWTYPRLSCPGSTFQKALLISPHRFGETKGNSAPLIIREPFIACGPNECKHFALTHYAAQPGGYYNGTRGDRNRLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERKGMGLYVKYDGDPWTDSDALAFRGVMVSMKEPGWYSFGFEIKDKKCDVPCIGIEMVHDGGKETWHSAATAIYCLMGSGQLLWDTVTGVDMAL

SEQ ID NO: 28955 - protein, 466 aa, Artificial Sequence
  neuraminidase__InfluenzaB__AFF18536
MLPSTIQMLTLFLTSGGVLLSLYVSASLSYLLYSDILLKFSPTEITAPTMPLDCANASNVHAVNRSATKGVTFLLPEPEWTYPRLSCPGSTFQKALLISPHRFGETKGNSAPLIIREPFIACGPNECRHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIRGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERKGMGLYVKYDGDPWTDSDALAFRGVMVSMKEPGWYSFGFEIKDKKCDVPCIGIEMVHDGGKETWHSAATAIYCLMGSGQLLWDTVTGVDMAL

SEQ ID NO: 28956 - protein, 466 aa, Artificial Sequence
  neuraminidase__InfluenzaB__AFF18545
MLPSTIQMLTLFLTSGGVLLSLYVSASLSYLLYSDILLKFSPTEITAPTMPLDCANASNVHAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERKGMGLYVKYDGDPWTDSDALAFRGVMVSMKEPGWYSFGFEIKDKKCDVPCIGIEMVHDGGKETWHSAATAIYCLMGSGQLLWDTVTGVDMAL

SEQ ID NO: 28957 - protein, 466 aa, Artificial Sequence; identical to SEQ ID NO: 28817
  neuraminidase__InfluenzaB__AFH34933

SEQ ID NO: 28958 - protein, 466 aa, Artificial Sequence; identical to SEQ ID NO: 28817
  neuraminidase__InfluenzaB__AFH34939

SEQ ID NO: 28959 - protein, 466 aa, Artificial Sequence; identical to SEQ ID NO: 28755
  neuraminidase__InfluenzaB__AFH57869

SEQ ID NO: 28960 - protein, 466 aa, Artificial Sequence
  neuraminidase__InfluenzaB__AFH57891
MLPSTIQTLTLFLTSGGVLLSLYVSASLSYLLYSDILLKFSQTEITAPIMPLDYANASNVQAVNHSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 28961 - protein, 466 aa, Artificial Sequence
  neuraminidase__InfluenzaB__AFH57913
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28962 - protein, 466 aa, Artificial Sequence; identical to SEQ ID NO: 28817
  neuraminidase__InfluenzaB__AFH57935

SEQ ID NO: 28963 - protein, 466 aa, Artificial Sequence; identical to SEQ ID NO: 28817
  neuraminidase__InfluenzaB__AFH57946

SEQ ID NO: 28964 - protein, 466 aa, Artificial Sequence; identical to SEQ ID NO: 28817
  neuraminidase__InfluenzaB__AFH57957

SEQ ID NO: 28965 - protein, 466 aa, Artificial Sequence; identical to SEQ ID NO: 28895
  neuraminidase__InfluenzaB__AFH57968

SEQ ID NO: 28966 - protein, 466 aa, Artificial Sequence
  neuraminidase__InfluenzaB__AFH57979
MLPSTIQTLTLFLTSGGVLLSLYVSALLSYLLYSDILLKFSPTEITAPTMSLDCANASNVQAVNRSATKGVIFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28967 - protein, 466 aa, Artificial Sequence; identical to SEQ ID NO: 28584
  neuraminidase__InfluenzaB__AFH58253

SEQ ID NO: 28968 - protein, 466 aa, Artificial Sequence; identical to SEQ ID NO: 28647
  neuraminidase__InfluenzaB__AFH58264

SEQ ID NO: 28969 - protein, 466 aa, Artificial Sequence; identical to SEQ ID NO: 28788
  neuraminidase__InfluenzaB__AFH58275

SEQ ID NO: 28970 - protein, 466 aa, Artificial Sequence; identical to SEQ ID NO: 28788
  neuraminidase__InfluenzaB__AFH58286

SEQ ID NO: 28971 - protein, 466 aa, Artificial Sequence; identical to SEQ ID NO: 28961
  neuraminidase__InfluenzaB__AFH58297

SEQ ID NO: 28972 - protein, 466 aa, Artificial Sequence
  neuraminidase__InfluenzaB__AFH58308
MLPSTIQTLTLFLTSGGVLLSLYVSASLSYLLYSDILLKFSRTETTAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 28973 - protein, 466 aa, Artificial Sequence; identical to SEQ ID NO: 28972
  neuraminidase__InfluenzaB__AFH58319

SEQ ID NO: 28974 - protein, 466 aa, Artificial Sequence
  neuraminidase__InfluenzaB__AFH58341
MLPSTIQTLTLFLTSGGVLLSLYVSASLSYLLYSDILLKFSRTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVRLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 28975 - protein, 466 aa, Artificial Sequence
  neuraminidase__InfluenzaB__AFH58363
MLPSTIQTLTLFLTSGGVLLSLYVSASLSYLLYSDILLKFPSTEITAPTMPLDCANASNVQAVNRSATKGVTFLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGGKGSGGIKGGFVHQRMASKIGRWYSRTMSKTERKGMGLYVKYDGDPWADSDALAFSGVMVSMEEPGWYSFGFEIKDKKCDVPCIGIEMVHDGGKETWHSAATAIYCLMGSGQLLWDTVTGVNMAL

SEQ ID NO: 28976 - protein, 466 aa, Artificial Sequence; identical to SEQ ID NO: 28975
  neuraminidase__InfluenzaB__AFH58374

SEQ ID NO: 28977 - protein, 466 aa, Artificial Sequence; identical to SEQ ID NO: 28961
  neuraminidase__InfluenzaB__AFH58385

SEQ ID NO: 28978 - protein, 466 aa, Artificial Sequence; identical to SEQ ID NO: 28961
  neuraminidase__InfluenzaB__AFH58396

SEQ ID NO: 28979 - protein, 466 aa, Artificial Sequence; identical to SEQ ID NO: 28961
  neuraminidase__InfluenzaB__AFH58407

SEQ ID NO: 28980 - protein, 466 aa, Artificial Sequence; identical to SEQ ID NO: 28961
  neuraminidase__InfluenzaB__AFH58418

SEQ ID NO: 28981 - protein, 466 aa, Artificial Sequence
  neuraminidase__InfluenzaB__AFH58429
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNETIECACRDNSYTAKRPFVKLNVETDTAEIRLMCTDTYLDTPRPNDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28982 - protein, 466 aa, Artificial Sequence
  neuraminidase__InfluenzaB__AFH58440
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIQEGRIIKEIFPTGRVKHTEECTCGFASNKTIECACRDNSYTAKRPFVKLNVETDTAEIRLMCTDTYLDTPRPNDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28983 - protein, 466 aa, Artificial Sequence
  neuraminidase__InfluenzaB__AFH58462
MLPSTIQTLTLFLTSGGVLLSLYVSASLSYLLYSDILLKFSPTEITAPTMPLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDEGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMTL

SEQ ID NO: 28984 - protein, 466 aa, Artificial Sequence; identical to SEQ ID NO: 28983
  neuraminidase__InfluenzaB__AFH58473

SEQ ID NO: 28985 - protein, 466 aa, Artificial Sequence; identical to SEQ ID NO: 28817
  neuraminidase__InfluenzaB__AFH58484

SEQ ID NO: 28986 - protein, 466 aa, Artificial Sequence; identical to SEQ ID NO: 28817
  neuraminidase__InfluenzaB__AFH58495

SEQ ID NO: 28987 - protein, 466 aa, Artificial Sequence; identical to SEQ ID NO: 28817
  neuraminidase__InfluenzaB__AFH58506

SEQ ID NO: 28988 - protein, 466 aa, Artificial Sequence
  neuraminidase__InfluenzaB__AFH58517
MLPSTIQTLTLFLTSGGVLLSLYVSALLSYLLYSDILLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGRLLWDTVTGVDMAL

SEQ ID NO: 28989 - protein, 466 aa, Artificial Sequence; identical to SEQ ID NO: 28895
  neuraminidase__InfluenzaB__AFH58528

SEQ ID NO: 28990 - protein, 466 aa, Artificial Sequence
  neuraminidase__InfluenzaB__AFH58539
MLPSTVQTLTLLLTSGGVLLSLYVSASLSYLLYSDVLLKFSSTKTTAPTMSLECTNASNAQTVNHSATKEMTFPPPEPEWTYPRLSCQGSTFQKALLISPHRFGEIKGNSAPLIIREPFVACGPKECRHFALTHYAAQPGGYYNGTRKDRNKLRHLVSVKLGKIPTVENSIFHMAAWSGSACHDGREWTYIGVDGPDNDALVKIKYGEAYTDTYHSYAHNILRTQESACNCIGGDCYLMITDGSASGISKCRFLKIREGRIIKEILPTGRVEHTEECTCGFASNKTIECACRDNSYTAKRPFVKLNVETDTAEIRLMCTKTYLDTPRPDDGSIAGPCESNGDKWLGGIKGGFVHQRMASKIGRWYSRTMSKTNRMGMELYVKYDGDPWTDSDALTLSGVMVSIEEPGWYSFGFEIKDKKCDVPCIGIEMVHDGGKDTWHSAATAIYCLMGSGQLLWDTATGVDMAL

SEQ ID NO: 28991 - protein, 466 aa, Artificial Sequence
  neuraminidase__InfluenzaB__AFH58550
MLPSTIQTLTLFLTSGGVLLSLYVSASLSYLLYSDILLKFSPTEITAPTMPLDCANASNVQAVNRSATKEMTLLLPEPEWTYPRLSCPGSTFQKALLISPHRFGETRGNSAPLTIREPFIACGPKECKHFALTHYAAQPGGYYNGTREDRNKLRHLISVKLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGRGGIKGGFVHQRMASKIGRWYSRTMSKTERMGMELYVKYDGDPWTDSEALAPSGVMVSMEEPGWYSFGFEIKDKKCDVPCIGIEMVHDGGKKTWHSAATAIYCLMGSGQLLWDTVTGVDMAL

SEQ ID NO: 28992 - protein, 466 aa, Artificial Sequence; identical to SEQ ID NO: 28991
  neuraminidase__InfluenzaB__AFH58561

SEQ ID NO: 28993 - protein, 466 aa, Artificial Sequence
  neuraminidase__InfluenzaB__AFJ69969
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESNGDKGSGGIKGGFVHQRMESKIGRWYSRTMSKTERMGMGLYVKYDGDPWTDSDALAFSGVMVSMKEPGWYSFGFEIKDKKCDVPCIGIEMVHDGGKETWHSAATAIYCLMGSGQLLWDTVTGVDMAL

SEQ ID NO: 28994 - protein, 466 aa, Artificial Sequence; identical to SEQ ID NO: 28956
  neuraminidase__InfluenzaB__AFJ69971

SEQ ID NO: 28995 - protein, 466 aa, Artificial Sequence
  neuraminidase__InfluenzaB__AFJ69973
MLPSTIQMLTLFLTSGGVLLSLYVSASLSYLLYSDILLKFSPTEITAPTMPLDCANASNVHAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSACRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERKGMGLYVKYDGDPWTDSDALAFRGVMVSMKEPGWYSFGFEIKDKKCDVPCIGIEMVHDGGKETWHSAATAIYCLMGSGQLLWDTVTGVDMAL

SEQ ID NO: 28996 - protein, 466 aa, Artificial Sequence; identical to SEQ ID NO: 28817
  neuraminidase__InfluenzaB__AFJ69975

SEQ ID NO: 28997 - protein, 466 aa, Artificial Sequence
  neuraminidase__InfluenzaB__AFJ69979
MLPSTIQTLTLFLTSGGVLLSLYVSASLSYLLYSDILLKFSPTEITAPTMPLDCANTSNVQAVNHSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 28998 - protein, 466 aa, Artificial Sequence; identical to SEQ ID NO: 28956
  neuraminidase__InfluenzaB__AFJ69981

SEQ ID NO: 28999 - protein, 466 aa, Artificial Sequence
  neuraminidase__InfluenzaB__AFJ69983
MLPSTIQMLTLFLTSGGVLLSLYVSASLSYLLYSDILLKFSPTEITAPTMPLDCANASNVHAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEILPTGRVKHTEECTCGFASNKTIECACRDNSYTAKRPFVKLNVETDTAEIRLMCTDTYLDTPRPDDGSITGPCESNGGKGSGGIKGGFVHQRMASKIGRWYSRTMSKTERKGMGLYVKYDGDPWTDSDALAFRGVMVSMKEPGWYSFGFEIKDKKCDVPCIGIEMVHDGGKETWHSAATAIYCLMGSGQLLWDTVTGVDMAL

SEQ ID NO: 29000 - protein, 466 aa, Artificial Sequence
  neuraminidase__InfluenzaB__AFJ69987
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGTKGGFVHQRMKSKIGRWYSRTMSKTERMGMGLYVKYDGDPWADSDALTFSGVMVSMKEPGWYSFGFEIKDKKCDVPCIGIEMVHDGGKETWHSAATAIYCLMGSGQLLWDTVTGVDMAL

SEQ ID NO: 29001 - protein, 466 aa, Artificial Sequence
  neuraminidase__InfluenzaB__AFJ76228
MLPSTIQTLTLFLTSGGVLLSLYVSASLSYLLYSGILLKFSPTEITAPTMPLNCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGDCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWIDSDALTLSGVMVSMEEPGWYSFGFEIKDKKCDVPCIGIEMVHDGGKKTWHSAATAIYCLMGSGQLLWDTVTGVDMAL

SEQ ID NO: 29002 - protein, 466 aa, Artificial Sequence; identical to SEQ ID NO: 28668
  neuraminidase__InfluenzaB__AFJ76261

SEQ ID NO: 29003 - protein, 466 aa, Artificial Sequence
  neuraminidase__InfluenzaB__AFJ76283
MLPSTIQTLTLFLTSGGVLLSLYVSASLSYLLYSDILLKFPPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALTFSGVMVSMEEPGWYSFGFEIKDKKCDVPCIGIEMVHDGGKETWHSAATAIYCLMGSGQLLWDTVTGVNMAL

SEQ ID NO: 29004 - protein, 466 aa, Artificial Sequence
  neuraminidase__InfluenzaB__AFJ76305
MLPSTIQTLTLFLTSGGVLLSLYVSASLSYLLYSDILLKFPSTEITAPTMPLDCANASNVQAVNRSATKGVTLLLPEPEWTYPRLSCPGSTFQRALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALTFSGVMVSMEEPGWYSFGFEIKDKKCDVPCIGIEMVHDGGKETWHSAATAIYCLMGSGQLLWDTVTGVDMAL

SEQ ID NO: 29005 - protein, 466 aa, Artificial Sequence
  neuraminidase__InfluenzaB__AFJ76316
MLPSTIQTLTLFLTSGGVLLSLYVSASLSYLLYSDILLKFPSTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALTFSGVMVSMEEPGWYSFGFEIKDKKCDVPCIGIEMVHDGGKETWHSAATAIYCLMGSGQLLWDTVTGVNMAL

SEQ ID NO: 29006 - protein, 466 aa, Artificial Sequence; identical to SEQ ID NO: 28668
  neuraminidase__InfluenzaB__AFJ76338

SEQ ID NO: 29007 - protein, 466 aa, Artificial Sequence
  neuraminidase__InfluenzaB__AFJ77331
MLPSTIQTLTLFLTSGGVLLSLYVSASLSYLLYSDILLKFSQTEITAPIMPLDCANASNVQAVNHSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESAYNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29008 - protein, 466 aa, Artificial Sequence; identical to SEQ ID NO: 28743
  neuraminidase__InfluenzaB__AFJ77351

SEQ ID NO: 29009 - protein, 466 aa, Artificial Sequence; identical to SEQ ID NO: 28635
  neuraminidase__InfluenzaB__AFJ77362

SEQ ID NO: 29010 - protein, 466 aa, Artificial Sequence; identical to SEQ ID NO: 28788
  neuraminidase__InfluenzaB__AFJ77384

SEQ ID NO: 29011 - protein, 466 aa, Artificial Sequence; identical to SEQ ID NO: 28710
  neuraminidase__InfluenzaB__AFJ80132

SEQ ID NO: 29012 - protein, 466 aa, Artificial Sequence
  neuraminidase__InfluenzaB__AFJ80143
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGNCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKKTWHSAATAIYCLMGSGQLLWDTVTGVDMAL

SEQ ID NO: 29013 - protein, 466 aa, Artificial Sequence
  neuraminidase__InfluenzaB__AFJ80154
MLPSTIQTLTLFLTSGGVLLSLYVSASLSYLLYSDILLKFSPTEITAPTMPLDCANASNVQAVNRSATKGVTLLLPEPEWTYPRLSCPGSTFQKAILISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGNCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKKTWHSAATAIYCLMGSGQLLWDTVTGVDMAL

SEQ ID NO: 29014 - protein, 466 aa, Artificial Sequence
  neuraminidase__InfluenzaB__AFJ80165
MLPSTIQTLTLFLTSGGVLLSLYVSASLSYLLYSDILLKFSPTEITAPTIPLDCANASNVQAVNRSATKGVTLLLPEPEWTYPRLSCPGSTFQKALLISPHRFGEIKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDIPCIGIEMVHDGGKETWHSAATAIYCLMGSGQLLWDTVTGVDMAL

SEQ ID NO: 29015 - protein, 466 aa, Artificial Sequence
  neuraminidase__InfluenzaB__AFJ80176
MLPSTIQTLTLFLTSGGVLLSLYVSASLSYLLYSDILLKFSPTEITVPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGNCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKKTWHSAATAIYCLMGSGQLLWDTVTGVDMAL

SEQ ID NO: 29016 - protein, 466 aa, Artificial Sequence
  neuraminidase__InfluenzaB__AFJ80187
MLPSTIQTLTLFLTSGGVLLSLYVSASLSYLLYSGILLKFSPTEITAPTMPLNCANASNFQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGDCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWIDSDALTLSGVMVSMEEPGWYSFGFEIKDKKCDVPCIGIEMVHDGGKKTWHSAATAIYCLMGSGQLLWDTVTGVDMAL

SEQ ID NO: 29017 - protein, 466 aa, Artificial Sequence; identical to SEQ ID NO: 29012
  neuraminidase__InfluenzaB__AFJ80198

SEQ ID NO: 29018 - protein, 466 aa, Artificial Sequence; identical to SEQ ID NO: 28640
  neuraminidase__InfluenzaB__AFJ80220

SEQ ID NO: 29019 - protein, 466 aa, Artificial Sequence
  neuraminidase__InfluenzaB__AFJ80231
MLPSTIQTLTLFLTSGGVLLSLYVSASLSYLLYSGILLKFSLTEITAPTMPLNCANASNVQAVNRSATKGVTLFLPEPEWTYPRLSCPGSTFQKALLISPHRFGETKGNSAPLIIREPFIACGPKECKHFALTHYAAQPGGYYNGTREDRNKLRHLISVELGKIPTVENSIFHMAAWSGSACHDGKEWTYIGVDGPDSNALLKIKYGEAYTDTYHSYANNILRTQESACNCIGGDCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWIDSDALTLSGVMVSMEEPGWYSFGFEIKDKKCDVPCIGIEMVHDGGKKTWHSAATAIYCLMGSGQLLWDTVTGVDMAL

SEQ ID NO: 29020 - protein, 466 aa, Artificial Sequence
  neuraminidase__InfluenzaB__AFJ80242
MLPSTIQTLTLFLTSGGVLLSLYVSALLSYLLYSDILLKFSPTKVIAPTMSLDCANASNVQAVNHSATEEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISRCRFLKIREGRIIKEIFPTGRVEHTEECTCGFASNKTIECACRDNSYTAKRPFVKLNVETDTAEIRLMCTETYLDTPRPDDGSITGPCESNGDKGNGGIKGGFVHQRMASRIGRWYSRTMSKTKRMGMELYVKYDGDPWTDSDALAPSGVMVSMEEPGWYSFGFEIKDKKCDVPCIGIEMVHDGGKTTWHSAATAIYCLMGSGQLLWDTVTGVDMAL

SEQ ID NO: 29021 - protein, 466 aa, Artificial Sequence
  neuraminidase__InfluenzaB__AFJ80660
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGDCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMTSKIGRWYSRTMSKTKRMGMGLYVKYDGDPWTDSDALALSGVMVSMEEPGWYSFGFEIKDKKCDVPCIGIEMVHDGGKKTWHSAATAIYCLMGSGQLLWDTVTGVDMAL

SEQ ID NO: 29022 - protein, 466 aa, Artificial Sequence; identical to SEQ ID NO: 29019
  neuraminidase__InfluenzaB__AFJ80671

SEQ ID NO: 29023 - protein, 466 aa, Artificial Sequence; identical to SEQ ID NO: 29019
  neuraminidase__InfluenzaB__AFJ80682

SEQ ID NO: 29024 - protein, 466 aa, Artificial Sequence
  neuraminidase__InfluenzaB__AFJ80693
MLPSTIQTLTLFLTSGGVLLSLYVSASLSYLLYSGILLKFSPTEITAPTMPLNCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGDCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESHGDKGSGGIKGGFVHQRMASKIGRWYSRTMSKTKRMGMGLYVKYDGDPWIDSGALTLSGVMVSMEEPGWYSFGFEIKDKKCDVPCIGIEMVHDGGKKTWHSAATAIYCLMGSGQLLWDTVTGVDMAL

SEQ ID NO: 29025 - protein, 466 aa, Artificial Sequence
  neuraminidase__InfluenzaB__AFJ80726
MLPSTIQTLTLFLTSGGVLLSLYVSASLSYLLYSDILLKFSQTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGSASGISECRFLKIREGRIIKEIFPTGRVKHTEECTCGFASNKTIECACRDNSYTAKRPFVKLNVETDTAEIRLMCTETYLDTPRPNDGSITGPCESNGDRGGGGIKGGFVHQRMASKIGRWYSRTMSKTKRMGMGLYVKYDGDPWTDSEALALSGVMVPMEEPGWYSFGFEIKDKKCDVPCIGIEMVHDGGKTTWHSAATAIYCLMGSGQLLWDTVTGVDMAL

SEQ ID NO: 29026 - protein, 466 aa, Artificial Sequence
  neuraminidase__InfluenzaB__AFJ80737
MLPSTIQTLTLFLTSGGVLLSLYVSASLSYLLYSDILLKFSQTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIRGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29027 - protein, 466 aa, Artificial Sequence; identical to SEQ ID NO: 28668
  neuraminidase__InfluenzaB__AFJ80759

SEQ ID NO: 29028 - protein, 466 aa, Artificial Sequence
  neuraminidase__InfluenzaB__AFJ80770
MLPSTIQTLTLFLTSGGVLLSLYVSASLSYLLYSDILLKFSQTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLDVETDTAEIRLMCTETYLDTPRPNDGSITGPCESNGDKGSGGIKGGFVHQRMASKIGRWYSRTLSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29029 - protein, 466 aa, Artificial Sequence; identical to SEQ ID NO: 28668
  neuraminidase__InfluenzaB__AFJ80785

SEQ ID NO: 29030 - protein, 466 aa, Artificial Sequence; identical to SEQ ID NO: 28668
  neuraminidase__InfluenzaB__AFJ80796

SEQ ID NO: 29031 - protein, 466 aa, Artificial Sequence
  neuraminidase__InfluenzaB__AFJ80807
MLPSTIQTLTLFLTSGGVLLSLYVSVSLSYLLYSDILLKFPSTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALAFSGVMVSMEEPGWYSFGFEIKDKKCDVPCIGIEMVHDGGKETWHSAATAIYCLMGSGQLLWDTVTGVNMAL

SEQ ID NO: 29032 - protein, 466 aa, Artificial Sequence; identical to SEQ ID NO: 28668
  neuraminidase__InfluenzaB__AFJ80818

SEQ ID NO: 29033 - protein, 466 aa, Artificial Sequence; identical to SEQ ID NO: 28668
  neuraminidase__InfluenzaB__AFJ80829

SEQ ID NO: 29034 - protein, 466 aa, Artificial Sequence; identical to SEQ ID NO: 29005
  neuraminidase__InfluenzaB__AFJ80840

SEQ ID NO: 29035 - protein, 466 aa, Artificial Sequence; identical to SEQ ID NO: 29005
  neuraminidase__InfluenzaB__AFJ80851

SEQ ID NO: 29036 - protein, 466 aa, Artificial Sequence
  neuraminidase__InfluenzaB__AFJ80862
MLPSTIQTLTLFLTSGGVLLSLYVSASLSYLLYSDILLKFPSTEITAPTMPLDCANASNVQAMNRSATKGVTLLLPETEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALTFSGVMVSMEEPGWYSFGFEIKDKKCDVPCIGIEMVHDGGKETWHSAATAIYCLMGSGQLLWDTVTGVNMAL

SEQ ID NO: 29037 - protein, 466 aa, Artificial Sequence
  neuraminidase__InfluenzaB__AFJ80873
MLPSTIQTLTLFLTSGGVLLSLYVSASLSHLLYSGILLKFPSTEITAPTMPLDCANASNVQAVNRSATKGVTLLPPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALTFSGVMVSMEEPGWYSFGFEIKDKKCDVPCIGIEMVHDGGKETWHSAATAIYCLMGSGQLLWDTVTGVNMAL

SEQ ID NO: 29038 - protein, 466 aa, Artificial Sequence
  neuraminidase__InfluenzaB__AFJ80884
MLPSTIQTLTLFLTSGGVLLSLYVSASLSYLLYSDILLKFPSTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSKCRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALTFSGVMVSMEEPGWYSFGFEIKDKKCDVPCIGIEMVHDGGKETWHSAATAIYCLMGSGQLLWDTVTGVNMAL

SEQ ID NO: 29039 - protein, 466 aa, Artificial Sequence; identical to SEQ ID NO: 29004
  neuraminidase__InfluenzaB__AFJ80895

SEQ ID NO: 29040 - protein, 466 aa, Artificial Sequence
  neuraminidase__InfluenzaB__AFJ80917
MLPSTIQTLTLFLTSGGVLLSLYVSASLSYLLYSDILLKFPSTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECTCRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALTFSGVMVSMEEPGWYSFGFEIKDKKCDVPCIGIEMVHDGGKETWHSAATAIYCLMGSGQLLWDTVTGVNMAL

SEQ ID NO: 29041 - protein, 466 aa, Artificial Sequence
  neuraminidase__InfluenzaB__AFJ80928
MLPSTIQTLTLFLTSGGVLLSLYVSASLSYLLYSDILLKFPSTEITAPTMPLDCANASNVQAVNRSATKGVTLLLPEPEWTYPRLSCPGSTFQKALLISPHRFGETKGNSAPLIIREPFIACEPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALTFSGVMVSMEEPGWYSFGFEIKDKKCDVPCIGIEMVHDGGKETWHSAATAIYCLMGSGQLLWDTVTGVNMAL

SEQ ID NO: 29042 - protein, 466 aa, Artificial Sequence
  neuraminidase__InfluenzaB__AFJ80939
MLPSTIQTLTLFLTSGGVLLSLYVSASLSYLLYSDILLKFPPTEVTAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALTFSGVMVSMEEPGWYSFGFEIKDKKCDVPCIGIEMVHDGGKETWHSAATAIYCLMGSGQLLWDTVTGVNMAL

SEQ ID NO: 29043 - protein, 466 aa, Artificial Sequence
  neuraminidase__InfluenzaB__AFJ80950
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGNGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29044 - protein, 466 aa, Artificial Sequence; identical to SEQ ID NO: 29005
  neuraminidase__InfluenzaB__AFJ80961

SEQ ID NO: 29045 - protein, 466 aa, Artificial Sequence; identical to SEQ ID NO: 28788
  neuraminidase__InfluenzaB__AFJ80972

SEQ ID NO: 29046 - protein, 466 aa, Artificial Sequence; identical to SEQ ID NO: 28788
  neuraminidase__InfluenzaB__AFJ80983

SEQ ID NO: 29047 - protein, 466 aa, Artificial Sequence; identical to SEQ ID NO: 28743
  neuraminidase__InfluenzaB__AFJ80994

SEQ ID NO: 29048 - protein, 466 aa, Artificial Sequence; identical to SEQ ID NO: 28788
  neuraminidase__InfluenzaB__AFJ81005

SEQ ID NO: 29049 - protein, 466 aa, Artificial Sequence; identical to SEQ ID NO: 28788
  neuraminidase__InfluenzaB__AFJ84364

SEQ ID NO: 29050 - protein, 466 aa, Artificial Sequence
  neuraminidase__InfluenzaB__AFJ90399
MLPSTIQTLTLFLTSGGVLLSLYVSASLSYLLYSDILLKFPSTEITAPPMPLDCANASNVQAVNRSATKGVTLLLPEPEWTYPRLSCPGSTFQRALLISPHRFGETKGNSAPLIIREPFIACGPRECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMTSKIGRWYSRTMSKTERMGMGLYVKYDGDPWADSDALTFSGVMVSMEEPGWYSFGFEIKDKKCDVPCIGIEMVHDGGKETWHSAATAIYCLMGSGQLLWDTVTGVNMAL

SEQ ID NO: 29051 - protein, 466 aa, Artificial Sequence
  neuraminidase__InfluenzaB__AFJ90410
MLPSTIQTLTLFLTSGGVLLSLYVSASLSYLLYSDILLKFSQTEITAPIMPLDCANASNVQAVNRSAAKGVTLLLPKPEWTYPRLSCPGSTFQKALLISPHRFGETKGNSAPLIIREPFIACGPTECKHFALTHYAAQPGGYYNGTREDRNNLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29052 - protein, 466 aa, Artificial Sequence
  neuraminidase__InfluenzaB__AFJ90432
MLPSTIQTLTLFLTSGGVLLSLYVSTSLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29053 - protein, 466 aa, Artificial Sequence; identical to SEQ ID NO: 28972
  neuraminidase__InfluenzaB__AFJ90443

SEQ ID NO: 29054 - protein, 466 aa, Artificial Sequence
  neuraminidase__InfluenzaB__AFJ90454
MLPSTIQTLTLFLTSGGVLLSLYVSASLSYLLYSDILLKFSQTEITAPIVPLDCANASNVQAVNRSAAKGVTLLLPEPEWTYPRLSCPGSTFQKALLISPHRFGETKGNSAPLIIREPFIACGPTECKHFALTHYAAQPGEYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29055 - protein, 466 aa, Artificial Sequence
  neuraminidase__InfluenzaB__AFJ91042
MLPSTIQTLTLFLTSGGVLLSLYVSASLSYLLYSDILLKFSQTEITAPIMPLDCANASNVQAVNRSAAKGVTLLIPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSIAGPCESDGDKGSGGIKGGFVHQRMTSKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29056 - protein, 466 aa, Artificial Sequence
  neuraminidase__InfluenzaB__AFJ91053
MLPSTIQTLTLFLTSGGVLLSLYVSASLSYLLYSDILLKFSQTEITAPIMPLDCANASNVQAVNRSAAKEVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29057 - protein, 466 aa, Artificial Sequence
  neuraminidase__InfluenzaB__AFJ91075
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNTLLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29058 - protein, 466 aa, Artificial Sequence; identical to SEQ ID NO: 28817
  neuraminidase__InfluenzaB__AFJ91086

SEQ ID NO: 29059 - protein, 466 aa, Artificial Sequence; identical to SEQ ID NO: 28817
  neuraminidase__InfluenzaB__AFJ91097

SEQ ID NO: 29060 - protein, 466 aa, Artificial Sequence; identical to SEQ ID NO: 28817
  neuraminidase__InfluenzaB__AFJ91108

SEQ ID NO: 29061 - protein, 466 aa, Artificial Sequence; identical to SEQ ID NO: 28817
  neuraminidase__InfluenzaB__AFJ91119

SEQ ID NO: 29062 - protein, 466 aa, Artificial Sequence; identical to SEQ ID NO: 28668
  neuraminidase__InfluenzaB__AFJ91707

SEQ ID NO: 29063 - protein, 466 aa, Artificial Sequence
  neuraminidase__InfluenzaB__AFK09801
MLPSTIQTLTLFLTSGGVLLSLYVSASLSYLLYSDILLKFSQTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGSASGISECRFLKIREGRIIKEIFPTGRVKHTEECTCGFASNKTIECACRDNSYTAKRPFVKLNVETDTAEIRLMCTETYLDTPRPNDGSITGPCESNGDRGSGGIKGGFVHQRMASKIGRWYSRTMSKTKRMGMGLYVKYDGDPWTDSEALALSGVMVPMEEPGWYSFGFEIKDKKCDVPCIGIEMVHDGGKTTWHSAATAIYCLMGSGQLLWDTVTGVDMAL

SEQ ID NO: 29064 - protein, 466 aa, Artificial Sequence; identical to SEQ ID NO: 28792
  neuraminidase__InfluenzaB__AFN54669

SEQ ID NO: 29065 - protein, 466 aa, Artificial Sequence; identical to SEQ ID NO: 28792
  neuraminidase__InfluenzaB__AFN54680

SEQ ID NO: 29066 - protein, 466 aa, Artificial Sequence; identical to SEQ ID NO: 28817
  neuraminidase__InfluenzaB__AFN54691

SEQ ID NO: 29067 - protein, 466 aa, Artificial Sequence; identical to SEQ ID NO: 28817
  neuraminidase__InfluenzaB__AFN54702

SEQ ID NO: 29068 - protein, 466 aa, Artificial Sequence; identical to SEQ ID NO: 28817
  neuraminidase__InfluenzaB__AFN54713

SEQ ID NO: 29069 - protein, 466 aa, Artificial Sequence; identical to SEQ ID NO: 28817
  neuraminidase__InfluenzaB__AFN54724

SEQ ID NO: 29070 - protein, 466 aa, Artificial Sequence; identical to SEQ ID NO: 28817
  neuraminidase__InfluenzaB__AFN54735

SEQ ID NO: 29071 - protein, 466 aa, Artificial Sequence; identical to SEQ ID NO: 28817
  neuraminidase__InfluenzaB__AFN54746

SEQ ID NO: 29072 - protein, 466 aa, Artificial Sequence; identical to SEQ ID NO: 28817
  neuraminidase__InfluenzaB__AFN54757

SEQ ID NO: 29073 - protein, 466 aa, Artificial Sequence; identical to SEQ ID NO: 28817
  neuraminidase__InfluenzaB__AFN54768

SEQ ID NO: 29074 - protein, 466 aa, Artificial Sequence; identical to SEQ ID NO: 28817
  neuraminidase__InfluenzaB__AFN54779

SEQ ID NO: 29075 - protein, 466 aa, Artificial Sequence; identical to SEQ ID NO: 28817
  neuraminidase__InfluenzaB__AFN54790

SEQ ID NO: 29076 - protein, 466 aa, Artificial Sequence; identical to SEQ ID NO: 28817
  neuraminidase__InfluenzaB__AFN54801

SEQ ID NO: 29077 - protein, 466 aa, Artificial Sequence; identical to SEQ ID NO: 28817
  neuraminidase__InfluenzaB__AFN54812

SEQ ID NO: 29078 - protein, 466 aa, Artificial Sequence
  neuraminidase__InfluenzaB__AFN54834
MLPSTIQTLTLFLTSGGVLLSLYVSASLSYLLYSDILLKFSRTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWIYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 29079 - protein, 466 aa, Artificial Sequence; identical to SEQ ID NO: 28817
  neuraminidase__InfluenzaB__AFN54845

SEQ ID NO: 29080 - protein, 466 aa, Artificial Sequence
  neuraminidase__InfluenzaB__AFN54856
MLPSTIQTLTLFLTSGGVLLSLYVSASLSYLLYSDILLKFSRTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGVSECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTATGVNMTL

SEQ ID NO: 29081 - protein, 466 aa, Artificial Sequence; identical to SEQ ID NO: 28817
  neuraminidase__InfluenzaB__AFN54867

SEQ ID NO: 29082 - protein, 466 aa, Artificial Sequence
  neuraminidase__InfluenzaB__AFU34598
MLPSTIQTLTLFLTSGGVLLSLYVSASLSYLLYSDILLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTRESACNCIGGNCYLMITDGSASGVSECRFLKIRVGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDVAL

SEQ ID NO: 29083 - protein, 466 aa, Artificial Sequence
  neuraminidase__InfluenzaB__AFU34609
MLPSTIQTLTLFLTSGGVLLSLYVSALLSYLLYSDILLKFSPTEITAPTMSLDCANASNVQAVNRSATRGVTFLLPEPEWAYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29084 - protein, 466 aa, Artificial Sequence
  neuraminidase__InfluenzaB__AFU34620
MLPSTIQTLTLFLTSGGVLLSLYVSALLSYLLYSDILLKFSPTEITAPTMSLDCANASNVQAVNRSATRGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29085 - protein, 466 aa, Artificial Sequence
  neuraminidase__InfluenzaB__AFU34631
MLPSTIQTLTLFLTSGGVLLSLYVSALLSYLLYSDILLKFSPTEITAPTMSLDCANASNVQAVNRSATRGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIRGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29086 - protein, 466 aa, Artificial Sequence
  neuraminidase__InfluenzaB__AFU34642
MLPSTIQTLTLFLTSGGVLLSLYVSASLSYLLYSDILLKFSPTEITAPTMSLDCANASNVQAVNRSATKGMTFLLPEPEWTYPRLSCPGSTFQKALLISPHRFGETKGNSAPLIIREPFIACGPNGCKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESYGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29087 - protein, 466 aa, Artificial Sequence
  neuraminidase__InfluenzaB__AGB97261
MLPSTIQTLTLFLTSGGVLLSLYVSASLSYLLYSDMLLKFSRTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 29088 - protein, 466 aa, Artificial Sequence
  neuraminidase__InfluenzaB__AGB97267
MLPSTIQTLTLFLTSGGVLLSLYVSASLSYLLYSDILLKFSQTEITAPIMPLDCTNASNVQAVNRSAAKGVTLLLPEPEWTYPRLSCPGSTFQKALLISPHRFGEIKGNSAPLIIREPFIACGPTECKHFALTHYAAQPGGYYNGTREDRNKLRHLISVKLGKIPTVENSIFHMAAWSGSACHDGKEWTYIGIDGPDSNALLKIKYGEAYTDTYHSYAKNILRTQESACNCIGGDCYLMITDGPASGVSECRFLKIREGRIIKEIFPTGRVKHTEECTCGFASNKTIECACRDNRYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29089 - protein, 466 aa, Artificial Sequence; identical to SEQ ID NO: 28817
  neuraminidase__InfluenzaB__AGR54784

SEQ ID NO: 29090 - protein, 466 aa, Artificial Sequence; identical to SEQ ID NO: 28682
  neuraminidase__InfluenzaB__AGX15491

SEQ ID NO: 29091 - protein, 466 aa, Artificial Sequence
  neuraminidase__InfluenzaB__AGX15533
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGKRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKVGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29092 - protein, 466 aa, Artificial Sequence; identical to SEQ ID NO: 28635
  neuraminidase__InfluenzaB__AGX15545

SEQ ID NO: 29093 - protein, 466 aa, Artificial Sequence; identical to SEQ ID NO: 28635
  neuraminidase__InfluenzaB__AGX15556

SEQ ID NO: 29094 - protein, 466 aa, Artificial Sequence
  neuraminidase__InfluenzaB__AGX15567
MLPSTIQTLTLFLTSGGVLLSLYVSASLSYLLYSDILLKFPSTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALAFSGVMVSMEEPGWYSFGFEIKDKKCDVPCIGIEMVHDGGKETWHSAATAIYCLMGSGQLLWDTVTGVNMAL

SEQ ID NO: 29095 - protein, 466 aa, Artificial Sequence; identical to SEQ ID NO: 28635
  neuraminidase__InfluenzaB__AGX15578

SEQ ID NO: 29096 - protein, 466 aa, Artificial Sequence; identical to SEQ ID NO: 28635
  neuraminidase__InfluenzaB__AGX15589

SEQ ID NO: 29097 - protein, 466 aa, Artificial Sequence; identical to SEQ ID NO: 28841
  neuraminidase__InfluenzaB__AGX15600

SEQ ID NO: 29098 - protein, 466 aa, Artificial Sequence; identical to SEQ ID NO: 28841
  neuraminidase__InfluenzaB__AGX15611

SEQ ID NO: 29099 - protein, 466 aa, Artificial Sequence; identical to SEQ ID NO: 28961
  neuraminidase__InfluenzaB__AGX15644

SEQ ID NO: 29100 - protein, 466 aa, Artificial Sequence; identical to SEQ ID NO: 28961
  neuraminidase__InfluenzaB__AGX15655

SEQ ID NO: 29101 - protein, 466 aa, Artificial Sequence; identical to SEQ ID NO: 28961
  neuraminidase__InfluenzaB__AGX15666

SEQ ID NO: 29102 - protein, 466 aa, Artificial Sequence; identical to SEQ ID NO: 28961
  neuraminidase__InfluenzaB__AGX15679

SEQ ID NO: 29103 - protein, 466 aa, Artificial Sequence
  neuraminidase__InfluenzaB__AGX15690
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESNGDKGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29104 - protein, 466 aa, Artificial Sequence; identical to SEQ ID NO: 28961
  neuraminidase__InfluenzaB__AGX15701

SEQ ID NO: 29105 - protein, 466 aa, Artificial Sequence
  neuraminidase__InfluenzaB__AGX15712
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGEPKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVNMAL

SEQ ID NO: 29106 - protein, 466 aa, Artificial Sequence; identical to SEQ ID NO: 28961
  neuraminidase__InfluenzaB__AGX15723

SEQ ID NO: 29107 - protein, 466 aa, Artificial Sequence; identical to SEQ ID NO: 28961
  neuraminidase__InfluenzaB__AGX15745

SEQ ID NO: 29108 - protein, 466 aa, Artificial Sequence; identical to SEQ ID NO: 28961
  neuraminidase__InfluenzaB__AGX15757

SEQ ID NO: 29109 - protein, 466 aa, Artificial Sequence
  neuraminidase__InfluenzaB__AGX15768
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESNGDKGSGGIKGGFVHQRMESKIGRWYSRTMSKTERMGMGLYVKYDGDPWADSDALAFSGVMISMKEPGWYSFGFEIKDKKCDVPCIGIEMVHDGGKETWHSAATAIYCLMGSGQLLWDTVTGVDMAL

SEQ ID NO: 29110 - protein, 466 aa, Artificial Sequence
  neuraminidase__InfluenzaB__AGX15801
MLPSTIQTLTLFLTSGGVLLSLYVSASLSYLLYSDILLKFSPTEITAPTMSLDCVNASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29111 - protein, 466 aa, Artificial Sequence; identical to SEQ ID NO: 28961
  neuraminidase__InfluenzaB__AGX15812

SEQ ID NO: 29112 - protein, 466 aa, Artificial Sequence; identical to SEQ ID NO: 28961
  neuraminidase__InfluenzaB__AGX15823

SEQ ID NO: 29113 - protein, 466 aa, Artificial Sequence; identical to SEQ ID NO: 28895
  neuraminidase__InfluenzaB__AGX15845

SEQ ID NO: 29114 - protein, 466 aa, Artificial Sequence; identical to SEQ ID NO: 28872
  neuraminidase__InfluenzaB__AGX15856

SEQ ID NO: 29115 - protein, 466 aa, Artificial Sequence; identical to SEQ ID NO: 28895
  neuraminidase__InfluenzaB__AGX15867

SEQ ID NO: 29116 - protein, 466 aa, Artificial Sequence; identical to SEQ ID NO: 28895
  neuraminidase__InfluenzaB__AGX15889

SEQ ID NO: 29117 - protein, 466 aa, Artificial Sequence
  neuraminidase__InfluenzaB__AGX15900
MLPSTIQTLTLFLTSGGVLLSLYVSALLSYLLYSDILLKFSPTEITAPTMSLDCANTSNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERRGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29118 - protein, 466 aa, Artificial Sequence; identical to SEQ ID NO: 28895
  neuraminidase__InfluenzaB__AGX15911

SEQ ID NO: 29119 - protein, 466 aa, Artificial Sequence
  neuraminidase__InfluenzaB__AGX15933
MLPSTIQTLTLFLTSGGVLLSLYVSASLSYLLYSDILLKFSPTEITAPAMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29120 - protein, 466 aa, Artificial Sequence; identical to SEQ ID NO: 28895
  neuraminidase__InfluenzaB__AGX15944

SEQ ID NO: 29121 - protein, 466 aa, Artificial Sequence; identical to SEQ ID NO: 28956
  neuraminidase__InfluenzaB__AGX15966

SEQ ID NO: 29122 - protein, 466 aa, Artificial Sequence
  neuraminidase__InfluenzaB__AGX15988
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEVRLMCTDTYLDTPRPNDGSITGPCESDGDKGSGGIKGGFVHQRMESKIGRWYSRTMSKTERMGMGLYVKYDGDPWADSDALTFSGVMVSMKEPGWYSFGFEIKDKKCDVPCIGIEMVHDGGKETWHSAATAIYCLMGSGQLLWDTVTGVDMAL

SEQ ID NO: 29123 - protein, 466 aa, Artificial Sequence; identical to SEQ ID NO: 28956
  neuraminidase__InfluenzaB__AGX15999

SEQ ID NO: 29124 - protein, 466 aa, Artificial Sequence; identical to SEQ ID NO: 28956
  neuraminidase__InfluenzaB__AGX16010

SEQ ID NO: 29125 - protein, 466 aa, Artificial Sequence; identical to SEQ ID NO: 28956
  neuraminidase__InfluenzaB__AGX16021

SEQ ID NO: 29126 - protein, 466 aa, Artificial Sequence
  neuraminidase__InfluenzaB__AGX16032
MLPSTIQTLTLFLTSGGVLLSLYVSASLSYLLYSDILLKFSQTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29127 - protein, 466 aa, Artificial Sequence; identical to SEQ ID NO: 28743
  neuraminidase__InfluenzaB__AGX16043

SEQ ID NO: 29128 - protein, 466 aa, Artificial Sequence; identical to SEQ ID NO: 28745
  neuraminidase__InfluenzaB__AGX16054

SEQ ID NO: 29129 - protein, 466 aa, Artificial Sequence
  neuraminidase__InfluenzaB__AGX16087
MLPSTIQTLTLFLTSGGVLLSLYVSASLSYLLYSDILLKFSQTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNNYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29130 - protein, 466 aa, Artificial Sequence
  neuraminidase__InfluenzaB__AGX16109
MLPSTIQTLTLFLTSGGVLLSLYVSASLSYLLYSDILLKFSQTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYVGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLDVETDTAEIRLMCTETYLDTPRPNDGSITGPCEANGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29131 - protein, 466 aa, Artificial Sequence
  neuraminidase__InfluenzaB__AGX16120
MLPSTIQTLTLFLTSGGVLLSLYVSASLSYLLYSDILLKFSTTEITAPTMPLDCANASNVQAVNRSATKGVTFLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGNKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 29132 - protein, 466 aa, Artificial Sequence; identical to SEQ ID NO: 29131
  neuraminidase__InfluenzaB__AGX16131

SEQ ID NO: 29133 - protein, 466 aa, Artificial Sequence; identical to SEQ ID NO: 29131
  neuraminidase__InfluenzaB__AGX16142

SEQ ID NO: 29134 - protein, 466 aa, Artificial Sequence
  neuraminidase__InfluenzaB__AGX16153
MLPSTIQTLTLFLTSGGVLLSLYVSASLSYLLYSDILLKFSQTEITAPIMPLDCANASNVQAVNRSATRGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMTAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29135 - protein, 466 aa, Artificial Sequence; identical to SEQ ID NO: 29129
  neuraminidase__InfluenzaB__AGX16164

SEQ ID NO: 29136 - protein, 466 aa, Artificial Sequence; identical to SEQ ID NO: 28788
  neuraminidase__InfluenzaB__AGX16197

SEQ ID NO: 29137 - protein, 466 aa, Artificial Sequence; identical to SEQ ID NO: 28788
  neuraminidase__InfluenzaB__AGX16208

SEQ ID NO: 29138 - protein, 466 aa, Artificial Sequence; identical to SEQ ID NO: 28788
  neuraminidase__InfluenzaB__AGX16219

SEQ ID NO: 29139 - protein, 466 aa, Artificial Sequence; identical to SEQ ID NO: 28627
  neuraminidase__InfluenzaB__AGX16230

SEQ ID NO: 29140 - protein, 466 aa, Artificial Sequence
  neuraminidase__InfluenzaB__AGX16241
MLPSTIQTLTLFLTSGGVLLSLYVSASLSYLLYSDILLKFSQTEITAPIMPLDCANASNVQAVNHSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSIIGPCESNGDKGSGGIKGGFVHQRMASKIGRWYSRTMSKTKRMGMGLYVKYDGDPWTDSEALTLSGVMVSMEEPGWYSFGFEIKDKKCDVPCIGIEMVHDGGKTTWHSAATAIYCLMGSGQLLWDTVTGVDMAL

SEQ ID NO: 29141 - protein, 466 aa, Artificial Sequence
  neuraminidase__InfluenzaB__AGX16252
MLPSTIQTLTLFLTSGGVLLSLYVSASLSYLLYSDILLKFSQTEITAPIMPLDCANASNVQAVNRSAAKGVTLLLPEPEWAYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNRYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29142 - protein, 466 aa, Artificial Sequence; identical to SEQ ID NO: 28788
  neuraminidase__InfluenzaB__AGX16274

SEQ ID NO: 29143 - protein, 466 aa, Artificial Sequence
  neuraminidase__InfluenzaB__AGX16285
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSTTGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29144 - protein, 466 aa, Artificial Sequence; identical to SEQ ID NO: 28788
  neuraminidase__InfluenzaB__AGX16296

SEQ ID NO: 29145 - protein, 466 aa, Artificial Sequence; identical to SEQ ID NO: 28635
  neuraminidase__InfluenzaB__AGX16307

SEQ ID NO: 29146 - protein, 466 aa, Artificial Sequence; identical to SEQ ID NO: 28788
  neuraminidase__InfluenzaB__AGX16329

SEQ ID NO: 29147 - protein, 466 aa, Artificial Sequence
  neuraminidase__InfluenzaB__AGX16362
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGVSECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29148 - protein, 466 aa, Artificial Sequence; identical to SEQ ID NO: 28960
  neuraminidase__InfluenzaB__AGX16373

SEQ ID NO: 29149 - protein, 466 aa, Artificial Sequence
  neuraminidase__InfluenzaB__AGX16384
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLKHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29150 - protein, 466 aa, Artificial Sequence; identical to SEQ ID NO: 28817
  neuraminidase__InfluenzaB__AGX16406

SEQ ID NO: 29151 - protein, 466 aa, Artificial Sequence; identical to SEQ ID NO: 28817
  neuraminidase__InfluenzaB__AGX16427

SEQ ID NO: 29152 - protein, 466 aa, Artificial Sequence; identical to SEQ ID NO: 28817
  neuraminidase__InfluenzaB__AGX16438

SEQ ID NO: 29153 - protein, 466 aa, Artificial Sequence; identical to SEQ ID NO: 28817
  neuraminidase__InfluenzaB__AGX16449

SEQ ID NO: 29154 - protein, 466 aa, Artificial Sequence; identical to SEQ ID NO: 28817
  neuraminidase__InfluenzaB__AGX16460

SEQ ID NO: 29155 - protein, 466 aa, Artificial Sequence
  neuraminidase__InfluenzaB__AGX16471
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDKGSGGIKGGFVHQRMASKIGRWYSRTMSKTRRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29156 - protein, 466 aa, Artificial Sequence; identical to SEQ ID NO: 28817
  neuraminidase__InfluenzaB__AGX16482

SEQ ID NO: 29157 - protein, 466 aa, Artificial Sequence
  neuraminidase__InfluenzaB__AGX16493
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVVVSMEEPGWYSFGFEIKDKKCDVPCIGIEMVHDGGKTTWHSAATAIYCLMGSGQLLWDTVTGVDMAL

SEQ ID NO: 29158 - protein, 466 aa, Artificial Sequence; identical to SEQ ID NO: 28616
  neuraminidase__InfluenzaB__AGX16504

SEQ ID NO: 29159 - protein, 466 aa, Artificial Sequence; identical to SEQ ID NO: 28616
  neuraminidase__InfluenzaB__AGX16515

SEQ ID NO: 29160 - protein, 466 aa, Artificial Sequence
  neuraminidase__InfluenzaB__AGX16548
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDNGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29161 - protein, 466 aa, Artificial Sequence
  neuraminidase__InfluenzaB__AGX16559
MLPSTIQTLTLFLTSGGVLLSLYVSASLSYLLYSDILLKFSPTEIIAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIRDKKCDVPCIGIEMVHDGGKETWHSAATAIYCLMGSGQLLWDTVTGVDMAL

SEQ ID NO: 29162 - protein, 466 aa, Artificial Sequence
  neuraminidase__InfluenzaB__AGX16581
MLPSTIQTLTLFLTSGGVLLSLYVSASLSYLLYSDILLKFSPTEIIAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29163 - protein, 466 aa, Artificial Sequence; identical to SEQ ID NO: 29162
  neuraminidase__InfluenzaB__AGX16592

SEQ ID NO: 29164 - protein, 466 aa, Artificial Sequence; identical to SEQ ID NO: 28616
  neuraminidase__InfluenzaB__AGX16603

SEQ ID NO: 29165 - protein, 466 aa, Artificial Sequence; identical to SEQ ID NO: 28682
  neuraminidase__InfluenzaB__AGX16614

SEQ ID NO: 29166 - protein, 466 aa, Artificial Sequence; identical to SEQ ID NO: 29160
  neuraminidase__InfluenzaB__AGX16625

SEQ ID NO: 29167 - protein, 466 aa, Artificial Sequence
  neuraminidase__InfluenzaB__AGX16636
MLPSTIQTLTLFLTSGGVLLSLYVSASLSYLLYSDILLKFSPTEIIAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWNTVTGVDMAL

SEQ ID NO: 29168 - protein, 466 aa, Artificial Sequence; identical to SEQ ID NO: 28614
  neuraminidase__InfluenzaB__AGX16647

SEQ ID NO: 29169 - protein, 466 aa, Artificial Sequence; identical to SEQ ID NO: 29162
  neuraminidase__InfluenzaB__AGX16658

SEQ ID NO: 29170 - protein, 466 aa, Artificial Sequence; identical to SEQ ID NO: 28616
  neuraminidase__InfluenzaB__AGX16669

SEQ ID NO: 29171 - protein, 466 aa, Artificial Sequence; identical to SEQ ID NO: 28682
  neuraminidase__InfluenzaB__AGX16680

SEQ ID NO: 29172 - protein, 466 aa, Artificial Sequence; identical to SEQ ID NO: 28616
  neuraminidase__InfluenzaB__AGX16691

SEQ ID NO: 29173 - protein, 466 aa, Artificial Sequence
  neuraminidase__InfluenzaB__AGX16702
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGKRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29174 - protein, 466 aa, Artificial Sequence
  neuraminidase__InfluenzaB__AGX16713
MLPSTIQTLTLFLTSGGVLLSLYVSASLSYLLYSDILLKFSPTEITAPTMPLDCANASNVQAVNRSATKGVTLLLPEPEWTYPRLSCPGSIFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIRDKKCDVPCIGIEMVHDGGKETWHSAATAIYCLMGSGQLLWDTVTGVDMAL

SEQ ID NO: 29175 - protein, 466 aa, Artificial Sequence; identical to SEQ ID NO: 28616
  neuraminidase__InfluenzaB__AGX16724

SEQ ID NO: 29176 - protein, 466 aa, Artificial Sequence; identical to SEQ ID NO: 29162
  neuraminidase__InfluenzaB__AGX16735

SEQ ID NO: 29177 - protein, 466 aa, Artificial Sequence; identical to SEQ ID NO: 29162
  neuraminidase__InfluenzaB__AGX16746

SEQ ID NO: 29178 - protein, 466 aa, Artificial Sequence; identical to SEQ ID NO: 28616
  neuraminidase__InfluenzaB__AGX16757

SEQ ID NO: 29179 - protein, 466 aa, Artificial Sequence
  neuraminidase__InfluenzaB__AGX16768
MLPSTIQTLTLFLTSGGVLLSLYVSASLSYLLYSDILLKFSPTEIIAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCKSNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29180 - protein, 466 aa, Artificial Sequence; identical to SEQ ID NO: 28682
  neuraminidase__InfluenzaB__AGX16779

SEQ ID NO: 29181 - protein, 466 aa, Artificial Sequence
  neuraminidase__InfluenzaB__AGX16790
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGGRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIRDKKCDVPCIGIEMVHDGGKETWHSAATAIYCLMGSGQLLWDTVTGVDMAL

SEQ ID NO: 29182 - protein, 466 aa, Artificial Sequence
  neuraminidase__InfluenzaB__AGX16801
MLPSTIQTLTLFLTSGGVLLSLYVSASLSYLLYSDILLKFSPTEIIAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29183 - protein, 466 aa, Artificial Sequence; identical to SEQ ID NO: 28616
  neuraminidase__InfluenzaB__AGX16812

SEQ ID NO: 29184 - protein, 466 aa, Artificial Sequence
  neuraminidase__InfluenzaB__AGX16823
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPADGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29185 - protein, 466 aa, Artificial Sequence; identical to SEQ ID NO: 28616
  neuraminidase__InfluenzaB__AGX16834

SEQ ID NO: 29186 - protein, 466 aa, Artificial Sequence
  neuraminidase__InfluenzaB__AGX16845
MLPSTIQTLTLFLTSGGVLLSLYVSASLSYLLYSDILLKFSPTEITTPTMPLDCANASNVQAVNRSATKGVTLLLPEPEWTYPRLSCPGSTFQKALLVSPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29187 - protein, 466 aa, Artificial Sequence
  neuraminidase__InfluenzaB__AGX16856
MLPSTIQTLTLFLTSGGVLLSLYVSASLSYLLYSDILLKFSPTEITAPTVPLDCANASNVQAVNRSATKGVTLLLPEPEWTYPRLSCPGSTFQKALLISPHRFGETKGNSAPLIIREPFIACGPKECKHFALTHYAAQPGGYYSGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKNKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29188 - protein, 466 aa, Artificial Sequence; identical to SEQ ID NO: 28616
  neuraminidase__InfluenzaB__AGX16867

SEQ ID NO: 29189 - protein, 466 aa, Artificial Sequence
  neuraminidase__InfluenzaB__AGX16878
MLPSTIQTLTLFLTSGGVLLSLYVSASLSYLLYSDILLKFSPTELTAPTMPLDCANASNVQAVNRSATKGVTLLLPEPEWTYPRLSCPGSTFQKALLISPHRFGETKGNSAPLIIREPFIACGPKECKHFALTHYAAQPGGYYNGKRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDNGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29190 - protein, 466 aa, Artificial Sequence; identical to SEQ ID NO: 29162
  neuraminidase__InfluenzaB__AGX16889

SEQ ID NO: 29191 - protein, 466 aa, Artificial Sequence
  neuraminidase__InfluenzaB__AGX16900
MLPSTIQTLTLFLTTGGVLLSLYVSASLSYLLYSDILLKFSPTEIIAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29192 - protein, 466 aa, Artificial Sequence
  neuraminidase__InfluenzaB__AGX16911
MLPSTIQTLTLFLTSGGVLLSLYVSALLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29193 - protein, 466 aa, Artificial Sequence
  neuraminidase__InfluenzaB__AGX16922
MLPSTIQTLTLFLTSGGVLLSLYVSASLSYLLYSDILLKFSPTEITAPTMPLDCANASNVQAVNRSATKGVTFLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29194 - protein, 466 aa, Artificial Sequence
  neuraminidase__InfluenzaB__AGX16933
MLPSTIQTLTLFLTSGGVLLSLYVSASLSYLLYSDILLKFSPTEINAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLLDTVTGVDMAL

SEQ ID NO: 29195 - protein, 466 aa, Artificial Sequence
  neuraminidase__InfluenzaB__AGX16944
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYSGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKNKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29196 - protein, 466 aa, Artificial Sequence; identical to SEQ ID NO: 28616
  neuraminidase__InfluenzaB__AGX16955

SEQ ID NO: 29197 - protein, 466 aa, Artificial Sequence; identical to SEQ ID NO: 28614
  neuraminidase__InfluenzaB__AGX16966

SEQ ID NO: 29198 - protein, 466 aa, Artificial Sequence; identical to SEQ ID NO: 28616
  neuraminidase__InfluenzaB__AGX16977

SEQ ID NO: 29199 - protein, 466 aa, Artificial Sequence; identical to SEQ ID NO: 28616
  neuraminidase__InfluenzaB__AGX16988

SEQ ID NO: 29200 - protein, 466 aa, Artificial Sequence; identical to SEQ ID NO: 29160
  neuraminidase__InfluenzaB__AGX16999

SEQ ID NO: 29201 - protein, 466 aa, Artificial Sequence; identical to SEQ ID NO: 28616
  neuraminidase__InfluenzaB__AGX17010

SEQ ID NO: 29202 - protein, 466 aa, Artificial Sequence; identical to SEQ ID NO: 29162
  neuraminidase__InfluenzaB__AGX17021

SEQ ID NO: 29203 - protein, 466 aa, Artificial Sequence
  neuraminidase__InfluenzaB__AGX17032
MLPSTIQTLTLFLTSGGVLLSLYVSASLSYLLYSDILLKFSPTEITAPTMPLDCANASDVQAVNRSATKGVTLLLPEPEWTYPRLSCPGSTFQKALLISPHRFGETKGNSAPLIIREPFIACGPKECKHFALTHYAAQPGGYYNRTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29204 - protein, 466 aa, Artificial Sequence; identical to SEQ ID NO: 28614
  neuraminidase__InfluenzaB__AGX17043

SEQ ID NO: 29205 - protein, 466 aa, Artificial Sequence
  neuraminidase__InfluenzaB__AGX17054
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDNGNGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29206 - protein, 466 aa, Artificial Sequence
  neuraminidase__InfluenzaB__AGX17065
MLPSTIQTLTLFLTSGGVLLSLYVSALLSYLLYSDILLKFSPTKIIAPTTSLDSANASNFQAVNHSATKEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTISKTKRMGMELYVKYDGDPWTDSDALAPSGVMVSIEEPGWYSFGFEIKDKKCDVPCIGIEMVHDGGKTTWHSAATAIYCLMGSGQLLWDTVTGVDMAL

SEQ ID NO: 29207 - protein, 466 aa, Artificial Sequence
  neuraminidase__InfluenzaB__AGX17076
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIRDKKCDVPCIGIEIVHDGGKETWHSAATAIYCLMGSGQLLWDTVTGVDMAL

SEQ ID NO: 29208 - protein, 466 aa, Artificial Sequence; identical to SEQ ID NO: 29162
  neuraminidase__InfluenzaB__AGX17087

SEQ ID NO: 29209 - protein, 466 aa, Artificial Sequence; identical to SEQ ID NO: 29162
  neuraminidase__InfluenzaB__AGX17098

SEQ ID NO: 29210 - protein, 466 aa, Artificial Sequence; identical to SEQ ID NO: 29162
  neuraminidase__InfluenzaB__AGX17109

SEQ ID NO: 29211 - protein, 466 aa, Artificial Sequence; identical to SEQ ID NO: 29162
  neuraminidase__InfluenzaB__AGX17120

SEQ ID NO: 29212 - protein, 466 aa, Artificial Sequence; identical to SEQ ID NO: 28614
  neuraminidase__InfluenzaB__AGX17131

SEQ ID NO: 29213 - protein, 466 aa, Artificial Sequence; identical to SEQ ID NO: 28616
  neuraminidase__InfluenzaB__AGX17142

SEQ ID NO: 29214 - protein, 466 aa, Artificial Sequence
  neuraminidase__InfluenzaB__AGX17153
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSIIGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29215 - protein, 466 aa, Artificial Sequence; identical to SEQ ID NO: 29162
  neuraminidase__InfluenzaB__AGX17164

SEQ ID NO: 29216 - protein, 467 aa, Artificial Sequence
  neuraminidase__InfluenzaB__AGX17175
MLPSTIQTLTLFLTSGGVLLSLYVSASLSYLLYSDILLKFSPTEITAPTMPLDCANASNVQAVNRSATKGVTLLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIRDKKCDVPCIGIEMVHDGGKETWHSAATAIYCLMGSGQLLWDTVTGVDMAL

SEQ ID NO: 29217 - protein, 466 aa, Artificial Sequence
  neuraminidase__InfluenzaB__AGX17186
MLPSTIQTLTLFLTSGGVLLSLYVSASLSYLLYSDILLKFSPTEITTPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKYTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTRRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29218 - protein, 466 aa, Artificial Sequence; identical to SEQ ID NO: 29193
  neuraminidase__InfluenzaB__AGX17197

SEQ ID NO: 29219 - protein, 466 aa, Artificial Sequence
  neuraminidase__InfluenzaB__AGX17208
MLPSTIQTLTLFLTSGGVLLSLYVSASLSYLLYSDILLKFSPTEITTPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTRRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29220 - protein, 466 aa, Artificial Sequence; identical to SEQ ID NO: 29162
  neuraminidase__InfluenzaB__AGX17219

SEQ ID NO: 29221 - protein, 466 aa, Artificial Sequence; identical to SEQ ID NO: 28616
  neuraminidase__InfluenzaB__AGX17230

SEQ ID NO: 29222 - protein, 466 aa, Artificial Sequence; identical to SEQ ID NO: 29162
  neuraminidase__InfluenzaB__AGX17241

SEQ ID NO: 29223 - protein, 466 aa, Artificial Sequence
  neuraminidase__InfluenzaB__AGX17252
MLPSTIQTLTLFLTSGGVLLSLYVSASLSYLLYSDILLKFSPTEITAPTMPLDCANASNVQAVNRSATKGVTLLLPELEWTYPRLSCPGSTFQKALLISPHRFGETKGNSAPLIIREPFIACGPKECKHFALTYYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPADGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29224 - protein, 466 aa, Artificial Sequence
  neuraminidase__InfluenzaB__AGX17263
MLPSTIQTLTLFLTSGGVLLSLYVSASLSYLLYSDILLKLSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29225 - protein, 466 aa, Artificial Sequence
  neuraminidase__InfluenzaB__AGX17274
MLPSTIQTLTLFLTSGGVLLSLYVSASLSYLLYSDILLKFSPTEINAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29226 - protein, 466 aa, Artificial Sequence
  neuraminidase__InfluenzaB__AGX17285
MLPSTIQTLTLFLTSGGVLLSLYMSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29227 - protein, 466 aa, Artificial Sequence
  neuraminidase__InfluenzaB__AGX17296
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGEAKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29228 - protein, 466 aa, Artificial Sequence; identical to SEQ ID NO: 29160
  neuraminidase__InfluenzaB__AGX17307

SEQ ID NO: 29229 - protein, 466 aa, Artificial Sequence; identical to SEQ ID NO: 28614
  neuraminidase__InfluenzaB__AGX17318

SEQ ID NO: 29230 - protein, 466 aa, Artificial Sequence
  neuraminidase__InfluenzaB__AGX17329
MLPSTIQTLTLFLTSGGVLLSLYVSASLSYLLYSDMLLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYSGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKNKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29231 - protein, 466 aa, Artificial Sequence; identical to SEQ ID NO: 29162
  neuraminidase__InfluenzaB__AGX17340

SEQ ID NO: 29232 - protein, 466 aa, Artificial Sequence
  neuraminidase__InfluenzaB__AGX17351
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCETNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29233 - protein, 466 aa, Artificial Sequence
  neuraminidase__InfluenzaB__AGX17362
MLPSTIQTLTLFLTSGGVLLSLYVSASLSYLLYSDILLKFSPTEITAPTIPLDCANASNIQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29234 - protein, 466 aa, Artificial Sequence
  neuraminidase__InfluenzaB__AGX17373
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFANNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVNMAL

SEQ ID NO: 29235 - protein, 466 aa, Artificial Sequence; identical to SEQ ID NO: 28614
  neuraminidase__InfluenzaB__AGX17384

SEQ ID NO: 29236 - protein, 466 aa, Artificial Sequence; identical to SEQ ID NO: 28682
  neuraminidase__InfluenzaB__AGX17395

SEQ ID NO: 29237 - protein, 466 aa, Artificial Sequence
  neuraminidase__InfluenzaB__AGX17404
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGSDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGIMVSMEEPGWYSFGFEIKDKKCDVPCIGIEMVHDGGKETWHSAATAIYCLMGSGQLLWDTVTGVDMAL

SEQ ID NO: 29238 - protein, 466 aa, Artificial Sequence
  neuraminidase__InfluenzaB__AGX17415
MLPSTIQTLTLFLTSGGVLLSLYVSASLSYLLYSDILLKFSPTEITAPTMPLDCANASNVQAVNRSATKGVTLLLPEPDWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29239 - protein, 466 aa, Artificial Sequence
  neuraminidase__InfluenzaB__AGX17426
MLPSTIQTLTLFLTSGGVLLSLYVSASLSYLLYSDILLKFSPTEITAPTMPLDCANASNVQAVNRSATKGVTFLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIRDKKCDVPCIGIEMVHDGGKETWHSAATAIYCLMGSGQLLWDTVTGVDMAL

SEQ ID NO: 29240 - protein, 466 aa, Artificial Sequence
  neuraminidase__InfluenzaB__AGX17437
MLPSTIQTLTLFLTSGGVLLSLYVSVSLSYLLYSDILLKFSPTEITAQTMPLDFANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIRDKKCDVPCIGIEMVHDGGKETWHSAATAIYCLMGSGQLLWDTVTGVDMAL

SEQ ID NO: 29241 - protein, 466 aa, Artificial Sequence
  neuraminidase__InfluenzaB__AGX17448
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCETNGDKGSGGIKGGFVHQRMASKIGRWYSRTMSKTKRMGMGLYVKYDGDPWADSDALVLSGVMVSMEEPGWYSFGFEIKDKKCDVPCIGIEMVHDGGKETWHSAATAIYCLMGSGQLLWDTVTGVDMAL

SEQ ID NO: 29242 - protein, 466 aa, Artificial Sequence
  neuraminidase__InfluenzaB__AGX17459
MLPSTIQTLTLFLTSGGVLLSLYVSASLSYLLYSDILLKFSPTEITASTMPLDCANASNVQAVNRSATKGVTLLLPEPDWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29243 - protein, 466 aa, Artificial Sequence; identical to SEQ ID NO: 28614
  neuraminidase__InfluenzaB__AGX17470

SEQ ID NO: 29244 - protein, 466 aa, Artificial Sequence
  neuraminidase__InfluenzaB__AGX17481
MLPSTIQTLTLFLTSGGVLLSLYVSASLSYLLYSDILLKFSPTEITAPTMPLDCANASNVQAVNRSATKGVTLILPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSVEEPGWYSFGFEIKDKKCDVPCIGIEMVHDGGKETWHSAATAIYCLMGSGQLLWDTVTGVDMAL

SEQ ID NO: 29245 - protein, 466 aa, Artificial Sequence
  neuraminidase__InfluenzaB__AGX17492
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDIAL

SEQ ID NO: 29246 - protein, 466 aa, Artificial Sequence
  neuraminidase__InfluenzaB__AGX17503
MLPSTIQTLTLFLTSGGVLLSLYVSASLSYLLYSDILLKFSPTEITAPTMPLDCANASNVQAVNRSATKGVTLLLPEPEWTYPRLSCPGLTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29247 - protein, 466 aa, Artificial Sequence; identical to SEQ ID NO: 28614
  neuraminidase__InfluenzaB__AGX17514

SEQ ID NO: 29248 - protein, 466 aa, Artificial Sequence
  neuraminidase__InfluenzaB__AGX17525
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGKRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIRDKKCDVPCIGIEMVHDGGKETWHSAATAIYCLMGSGQLLWDTVTGVDMAL

SEQ ID NO: 29249 - protein, 466 aa, Artificial Sequence; identical to SEQ ID NO: 29193
  neuraminidase__InfluenzaB__AGX17536

SEQ ID NO: 29250 - protein, 466 aa, Artificial Sequence; identical to SEQ ID NO: 29224
  neuraminidase__InfluenzaB__AGX17547

SEQ ID NO: 29251 - protein, 466 aa, Artificial Sequence
  neuraminidase__InfluenzaB__AGX17558
MLPSTIQTLTLFLTSGGVLLSLYVSASLSYLLYSDVLLKFSPAEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29252 - protein, 466 aa, Artificial Sequence; identical to SEQ ID NO: 28743
  neuraminidase__InfluenzaB__AGX17569

SEQ ID NO: 29253 - protein, 466 aa, Artificial Sequence; identical to SEQ ID NO: 28670
  neuraminidase__InfluenzaB__AGX17580

SEQ ID NO: 29254 - protein, 466 aa, Artificial Sequence
  neuraminidase__InfluenzaB__AGX17591
MLPSTIQTLTLFLTSGGVLLSLYVSASLSYLLYSDILLKFPPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALAFSGVMVSMEEPGWYSFGFEIKDKKCDVPCIGIEMVHDGGKETWHSAATAIYCLMGSGQLLWDTVTGVNMAL

SEQ ID NO: 29255 - protein, 466 aa, Artificial Sequence; identical to SEQ ID NO: 28668
  neuraminidase__InfluenzaB__AGX17602

SEQ ID NO: 29256 - protein, 466 aa, Artificial Sequence; identical to SEQ ID NO: 29254
  neuraminidase__InfluenzaB__AGX17613

SEQ ID NO: 29257 - protein, 466 aa, Artificial Sequence; identical to SEQ ID NO: 28841
  neuraminidase__InfluenzaB__AGX17624

SEQ ID NO: 29258 - protein, 466 aa, Artificial Sequence
  neuraminidase__InfluenzaB__AGX17635
MLPSTIQTLTLFLTSGGVLLSLYVSASLSYLLYSDILLKFPPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALAFSGVMVSMEEPGWYSFGFEIKDKKCDVPCIGIEMVHDGGKETWHSAATAIYCLMGSGQLLWDTVTGVNMAL

SEQ ID NO: 29259 - protein, 466 aa, Artificial Sequence; identical to SEQ ID NO: 28841
  neuraminidase__InfluenzaB__AGX17657

SEQ ID NO: 29260 - protein, 466 aa, Artificial Sequence; identical to SEQ ID NO: 29254
  neuraminidase__InfluenzaB__AGX17668

SEQ ID NO: 29261 - protein, 466 aa, Artificial Sequence
  neuraminidase__InfluenzaB__AGX17679
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVEIDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29262 - protein, 466 aa, Artificial Sequence; identical to SEQ ID NO: 28841
  neuraminidase__InfluenzaB__AGX17690

SEQ ID NO: 29263 - protein, 466 aa, Artificial Sequence
  neuraminidase__InfluenzaB__AGX17701
MLPSTIQTLTLFLTSGGVLLSLYVSASLSYLLYSDILLKFPPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGKRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALAFSGVMVSMEEPGWYSFGFEIKDKKCDVPCIGIEMVHDGGKETWHSAATAIYCLMGSGQLLWDTVTGVNMAL

SEQ ID NO: 29264 - protein, 466 aa, Artificial Sequence; identical to SEQ ID NO: 28841
  neuraminidase__InfluenzaB__AGX17723

SEQ ID NO: 29265 - protein, 466 aa, Artificial Sequence; identical to SEQ ID NO: 29261
  neuraminidase__InfluenzaB__AGX17734

SEQ ID NO: 29266 - protein, 466 aa, Artificial Sequence
  neuraminidase__InfluenzaB__AGX17745
MLPSTIQTLTLFLTSGGVLLSLYVSASLSYLLYSDILLKFPPTEITAPTMPLDCANASNVQAVNRSATKGVTLLLPEPEWTYPRLSCSGSTFQKALLISPHRFGEIKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALAFSGVMVSMEEPGWYSFGFEIKDKKCDVPCIGIEMVHDGGKETWHSAATAIYCLMGSGQLLWDTVTGVNMAL

SEQ ID NO: 29267 - protein, 466 aa, Artificial Sequence
  neuraminidase__InfluenzaB__AGX17756
MLPSTIQTLTLFLTSGGVLLSLYVSASLSYLLYSDILLKFSPTEITAPTMPLDCANASNVHAVNRSATKGVTLLLPEPEWTYPRLSCPGSTFQKALLISPHRFGETKGNSAPLIIREPFIACGPNECKHFALTHYAARPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29268 - protein, 466 aa, Artificial Sequence; identical to SEQ ID NO: 28888
  neuraminidase__InfluenzaB__AGX17767

SEQ ID NO: 29269 - protein, 466 aa, Artificial Sequence
  neuraminidase__InfluenzaB__AGX17778
MLPSTIQTLTLFLTSGGVLLSLYVSASLSYLLYSDILLKFSPTEITAPTMPLDCANASNVHAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWAESDALAFSGVMVSMKEPGWYSFGFEIKDKKCDVPCIGIEMVHDGGKETWHSAATAIYCLMGSGQLLWDTVTGVDMAL

SEQ ID NO: 29270 - protein, 466 aa, Artificial Sequence
  neuraminidase__InfluenzaB__AGX17789
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVEIDTAEIRLMCTDTYLDTPRPDDGSITGPCESNGDKGSGGIKGGFVHQRMASKIGRWYSRTMSKTERMGMGLYVKYDGDPWADSDALVFSGVMVSMKEPGWYSFGFEIKDKKCDVPCIGIEMVHDGGKETWHSAATAIYCLMGSGQLLWDTVTGVDMAL

SEQ ID NO: 29271 - protein, 466 aa, Artificial Sequence; identical to SEQ ID NO: 28841
  neuraminidase__InfluenzaB__AGX17800

SEQ ID NO: 29272 - protein, 466 aa, Artificial Sequence
  neuraminidase__InfluenzaB__AGX17811
MLPSTIQTLTLFLTSGGVLLSLYVSASLSYLLYSDILLKFPPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALAFSGVMVSMEEPGWYSFGFEIKDKKCDVPCIGIEMVHDGGKETWHSAATAIYCLMGSGQLLWDTVTGVNMAQ

SEQ ID NO: 29273 - protein, 466 aa, Artificial Sequence; identical to SEQ ID NO: 29254
  neuraminidase__InfluenzaB__AGX17822

SEQ ID NO: 29274 - protein, 466 aa, Artificial Sequence
  neuraminidase__InfluenzaB__AGX17833
MLPSTIQTLTLFLTSGGVLLSLYVSASLSYLLYSDILLKFPPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISIKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALAFSGVMVSMEEPGWYSFGFEIKDKKCDVPCIGIEMVHDGGKETWHSAATAIYCLMGSGQLLWDTVTGVNMAL

SEQ ID NO: 29275 - protein, 466 aa, Artificial Sequence; identical to SEQ ID NO: 29261
  neuraminidase__InfluenzaB__AGX17844

SEQ ID NO: 29276 - protein, 466 aa, Artificial Sequence; identical to SEQ ID NO: 29269
  neuraminidase__InfluenzaB__AGX17855

SEQ ID NO: 29277 - protein, 466 aa, Artificial Sequence; identical to SEQ ID NO: 28888
  neuraminidase__InfluenzaB__AGX17866

SEQ ID NO: 29278 - protein, 466 aa, Artificial Sequence; identical to SEQ ID NO: 29254
  neuraminidase__InfluenzaB__AGX17877

SEQ ID NO: 29279 - protein, 466 aa, Artificial Sequence; identical to SEQ ID NO: 29261
  neuraminidase__InfluenzaB__AGX17888

SEQ ID NO: 29280 - protein, 466 aa, Artificial Sequence; identical to SEQ ID NO: 29254
  neuraminidase__InfluenzaB__AGX17899

SEQ ID NO: 29281 - protein, 466 aa, Artificial Sequence; identical to SEQ ID NO: 29261
  neuraminidase__InfluenzaB__AGX17910

SEQ ID NO: 29282 - protein, 466 aa, Artificial Sequence; identical to SEQ ID NO: 29261
  neuraminidase__InfluenzaB__AGX17921

SEQ ID NO: 29283 - protein, 466 aa, Artificial Sequence; identical to SEQ ID NO: 28888
  neuraminidase__InfluenzaB__AGX17932

SEQ ID NO: 29284 - protein, 466 aa, Artificial Sequence
  neuraminidase__InfluenzaB__AGX17943
MLPSTIQTLTLFLTSGGVLLSLYVSASLSYLLYSDILLKFPPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVRLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALAFSGVMVSMEEPGWYSFGFEIKDKKCDVPCIGIEMVHDGGKETWHSAATAIYCLMGSGQLLWDTVTGVNMAL

SEQ ID NO: 29285 - protein, 466 aa, Artificial Sequence; identical to SEQ ID NO: 29254
  neuraminidase__InfluenzaB__AGX17954

SEQ ID NO: 29286 - protein, 466 aa, Artificial Sequence
  neuraminidase__InfluenzaB__AGX17976
MLPSTIQTLTLFLTSGGVLLSLYVSASLSYLLYSDILLKFSPTEITAPTMPLDCANASNVHAVNRSATKGVTPLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29287 - protein, 466 aa, Artificial Sequence
  neuraminidase__InfluenzaB__AGX17987
MLPSTIQTLTLFLTSGGVLLSLYVSVSLSYLLYSDILLKFPPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALAFSGVMVSMEEPGWYSFGFEIKDKKCDVPCIGIEMVHDGGKETWHSAATAIYCLMGSGQLLWDTVTGVNMAL

SEQ ID NO: 29288 - protein, 466 aa, Artificial Sequence; identical to SEQ ID NO: 29261
  neuraminidase__InfluenzaB__AGX17998

SEQ ID NO: 29289 - protein, 466 aa, Artificial Sequence; identical to SEQ ID NO: 29254
  neuraminidase__InfluenzaB__AGX18009

SEQ ID NO: 29290 - protein, 466 aa, Artificial Sequence; identical to SEQ ID NO: 29287
  neuraminidase__InfluenzaB__AGX18020

SEQ ID NO: 29291 - protein, 466 aa, Artificial Sequence; identical to SEQ ID NO: 29254
  neuraminidase__InfluenzaB__AGX18031

SEQ ID NO: 29292 - protein, 466 aa, Artificial Sequence
  neuraminidase__InfluenzaB__AGX18042
MLPSTIQTLTLFLTSGGVLLSLYVSASLSYLLYSDILLKFSPTEITAPTMPLNCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVEIDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29293 - protein, 466 aa, Artificial Sequence; identical to SEQ ID NO: 29261
  neuraminidase__InfluenzaB__AGX18053

SEQ ID NO: 29294 - protein, 466 aa, Artificial Sequence; identical to SEQ ID NO: 29261
  neuraminidase__InfluenzaB__AGX18064

SEQ ID NO: 29295 - protein, 466 aa, Artificial Sequence
  neuraminidase__InfluenzaB__AGX18075
MLPSTIQTLTLFLTSGGVLLSLYVSASLSYLLYSDILLKFPPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSSCHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALAFSGVMVSMEEPGWYSFGFEIKDKKCDVPCIGIEMVHDGGKETWHSAATAIYCLMGSGQLLWDTVTGVNMAL

SEQ ID NO: 29296 - protein, 466 aa, Artificial Sequence; identical to SEQ ID NO: 28888
  neuraminidase__InfluenzaB__AGX18086

SEQ ID NO: 29297 - protein, 466 aa, Artificial Sequence; identical to SEQ ID NO: 28888
  neuraminidase__InfluenzaB__AGX18097

SEQ ID NO: 29298 - protein, 466 aa, Artificial Sequence; identical to SEQ ID NO: 28841
  neuraminidase__InfluenzaB__AGX18108

SEQ ID NO: 29299 - protein, 466 aa, Artificial Sequence
  neuraminidase__InfluenzaB__AGX18119
MLPSTIQTLTLFLTSGGVLLSLYVSASLSYLLYSDILLKFSPTEITAPTMPLDCANTSNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNMETDTAEIKLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29300 - protein, 466 aa, Artificial Sequence
  neuraminidase__InfluenzaB__AGX18130
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVEIDTAEIRLMCTDTYLDTPRPDDGSITGPCESNGDKGSGGIKGGFVHQRMASKIGRWYSRTMSRTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29301 - protein, 466 aa, Artificial Sequence
  neuraminidase__InfluenzaB__AGX18141
MLPSTIQTLTLFLTSGGVLLSLYVSASLSYLLYSDILLKFPSTEITAPTMPLDCANASNVQAVNRSATKGMTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWAESDALAFSGVMVSMEEPGWYSFGFEIKDKKCDVPCIGIEMVHDGGKETWHSAATAIYCLMGSGQLLWDTVTGVNMAL

SEQ ID NO: 29302 - protein, 466 aa, Artificial Sequence; identical to SEQ ID NO: 28888
  neuraminidase__InfluenzaB__AGX18152

SEQ ID NO: 29303 - protein, 466 aa, Artificial Sequence
  neuraminidase__InfluenzaB__AGX18163
MLPSTIQTLTLFLTSGGVLLSLYVSASLSYLLYSDILLKFPSTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGKRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALAFSGVMVSMEEPGWYSFGFEIKDKKCDVPCIGIEMVHDGGKETWHSAATAIYCLMGSGQLLWDTVTGVNMAL

SEQ ID NO: 29304 - protein, 466 aa, Artificial Sequence; identical to SEQ ID NO: 29254
  neuraminidase__InfluenzaB__AGX18174

SEQ ID NO: 29305 - protein, 466 aa, Artificial Sequence; identical to SEQ ID NO: 28888
  neuraminidase__InfluenzaB__AGX18185

SEQ ID NO: 29306 - protein, 466 aa, Artificial Sequence; identical to SEQ ID NO: 28841
  neuraminidase__InfluenzaB__AGX18196

SEQ ID NO: 29307 - protein, 466 aa, Artificial Sequence
  neuraminidase__InfluenzaB__AGX18207
MLPSTIQTLTLFLTSGGVLLSLYVSASLSYLLYSDILLKFPPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVETSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALAFSGVMVSMEEPGWYSFGFEIKDKKCDVPCIGIEMVHDGGKETWHSAATAIYCLMGSGQLLWDTVTGVNMAL

SEQ ID NO: 29308 - protein, 466 aa, Artificial Sequence
  neuraminidase__InfluenzaB__AGX18218
MLPSTIQTLTLFLTSGGVLLSLYVSASLSYLLYSDILLKLSPTEITAPTMPLDCANTSNVQAVNRSATKGVTLLLPEPEWTYPRLSCPGSTFQKALLISPHRFGETKGNSAPLIIREPFIACGPNECKHFALTHYAAQPGGYYNRTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNMETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29309 - protein, 466 aa, Artificial Sequence; identical to SEQ ID NO: 29261
  neuraminidase__InfluenzaB__AGX18229

SEQ ID NO: 29310 - protein, 466 aa, Artificial Sequence
  neuraminidase__InfluenzaB__AGX18240
MLPSTIQTLTLFLTSGGVLLSLYVSASLSYLLYSDILLKFSPTEITAPTMPLDCANASNVQTVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVEIDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29311 - protein, 466 aa, Artificial Sequence; identical to SEQ ID NO: 29254
  neuraminidase__InfluenzaB__AGX18251

SEQ ID NO: 29312 - protein, 466 aa, Artificial Sequence
  neuraminidase__InfluenzaB__AGX18262
MLPSTIQTLTLFLTSGGVLLSLYVSASLSYLLYSNILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKVGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29313 - protein, 466 aa, Artificial Sequence; identical to SEQ ID NO: 29261
  neuraminidase__InfluenzaB__AGX18273

SEQ ID NO: 29314 - protein, 466 aa, Artificial Sequence; identical to SEQ ID NO: 29286
  neuraminidase__InfluenzaB__AGX18284

SEQ ID NO: 29315 - protein, 466 aa, Artificial Sequence; identical to SEQ ID NO: 29261
  neuraminidase__InfluenzaB__AGX18295

SEQ ID NO: 29316 - protein, 466 aa, Artificial Sequence; identical to SEQ ID NO: 28888
  neuraminidase__InfluenzaB__AGX18306

SEQ ID NO: 29317 - protein, 466 aa, Artificial Sequence
  neuraminidase__InfluenzaB__AGX18317
MLPSTIQTLTLFLTSGGVLLSLYVSASLSYLLYSDILLKFPSTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNETRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWADSDALAFSGVMVSMEEPGWYSFGFEIKDKKCDVPCIGIEMVHDGGKETWHSAATAIYCLMGSGQLLWDTVTGVNMAL

SEQ ID NO: 29318 - protein, 466 aa, Artificial Sequence; identical to SEQ ID NO: 29261
  neuraminidase__InfluenzaB__AGX18328

SEQ ID NO: 29319 - protein, 466 aa, Artificial Sequence
  neuraminidase__InfluenzaB__AGX18339
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKVGRWYSRTMSKTERMGMGLYVKYDGDPWADSDALAFGGVMVSMKEPGWYSFGFEIKDKKCDVPCIGIEMVHDGGKETWHSAATAIYCLMGSGQLLWDTVTGVDMAL

SEQ ID NO: 29320 - protein, 466 aa, Artificial Sequence
  neuraminidase__InfluenzaB__AGX18350
MLPSTIQTLTLFLTSGGVLLSLYVSASLSYLLYSDILLKFSPTEITAPTMPLDCANASNVQAMNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVEIDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29321 - protein, 466 aa, Artificial Sequence; identical to SEQ ID NO: 29286
  neuraminidase__InfluenzaB__AGX18361

SEQ ID NO: 29322 - protein, 466 aa, Artificial Sequence
  neuraminidase__InfluenzaB__AGX18383
MLPSTIQTLTLFLTSGGVLLSLYVSASLSYLLYSDILLKFSPTEITAPTMPLDCANTSNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNMETDTAEIRLMCTDTYLDTPRPDDGSITGPCESNGDKGSGGIKGGFVHQRMASKIGRWYSRTMSKTERMGMGLYVKYDGDPWADSDALVFSGVMVSMKEPGWYSFGFEIKDKKCDVPCIGIEMVHGGGKETWHSAATAIYCLMGSGQLLWDTVTGVDMAL

SEQ ID NO: 29323 - protein, 466 aa, Artificial Sequence; identical to SEQ ID NO: 28888
  neuraminidase__InfluenzaB__AGX18394

SEQ ID NO: 29324 - protein, 466 aa, Artificial Sequence
  neuraminidase__InfluenzaB__AGX18405
MLPSTIQTLTLFLTSGGVLLSLYVSASLSYLLYSDILLKFSPTEITAPTMPLDCANASNVHAVNRSATKGVTPLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECVCRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29325 - protein, 466 aa, Artificial Sequence
  neuraminidase__InfluenzaB__AGX18416
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVEIDTAEIRLMCTDTYLDTPRPDDGSITGSCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29326 - protein, 466 aa, Artificial Sequence
  neuraminidase__InfluenzaB__AGX18428
MLPSTIQTLTLFLTSGGVLLSLYVSASLSYLLYSDILLKFSTTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGNKGSGGIKGGFVHQRMASKIGRWYSRTMSKTKRMGMGLYVKYDGDPWIDSDALALSGVMVSMEEPGWYSFGFEIKDKKCDVPCIGIEMVHDGGKETWHSAATAIYCLMGSGQLLWDTVTGVDMAL

SEQ ID NO: 29327 - protein, 466 aa, Artificial Sequence
  neuraminidase__InfluenzaB__AGX18439
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVEIDTAEIRLMCTDTYLDTPRPDDGSITGPCESNGDKGSGGIKGGFVHQRMASKIGRWYSRTMSKTERMGMGLYVKYDGDPWADSDALAFSGLMVSMKEPGWYSFGFEIKDKKCDVPCIGIEMVHDGGKETWHSAATAIYCLMGSGQLLWDTVTGVDMAL

SEQ ID NO: 29328 - protein, 466 aa, Artificial Sequence
  neuraminidase__InfluenzaB__AGX18450
MLPSTIQTLTLFLTSGGVLLSLYVSASLSYLLYSDILLKFSPTEITASTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVEIDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29329 - protein, 466 aa, Artificial Sequence; identical to SEQ ID NO: 28888
  neuraminidase__InfluenzaB__AGX18461

SEQ ID NO: 29330 - protein, 466 aa, Artificial Sequence
  neuraminidase__InfluenzaB__AGX18472
MLPSTIQTLTLFLTSGGVLLSLYVSASLSYLLYSDILLKFSPTEITAPTMPLDCANASNVHAVNHSATKGVTPLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29331 - protein, 466 aa, Artificial Sequence; identical to SEQ ID NO: 28888
  neuraminidase__InfluenzaB__AGX18483

SEQ ID NO: 29332 - protein, 466 aa, Artificial Sequence; identical to SEQ ID NO: 28635
  neuraminidase__InfluenzaB__AGX18494

SEQ ID NO: 29333 - protein, 466 aa, Artificial Sequence
  neuraminidase__InfluenzaB__AGX18505
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTISKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29334 - protein, 466 aa, Artificial Sequence
  neuraminidase__InfluenzaB__AGX18516
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTISKTERMGMGLYVKYDGDPWADSDALAFSGVMVSMKEPGWYSFGFEIKDKKCDVPCIGIEMVHGGGKETWHSAATAIYCLMGSGQLLWDTVTGVDMAL

SEQ ID NO: 29335 - protein, 466 aa, Artificial Sequence; identical to SEQ ID NO: 28635
  neuraminidase__InfluenzaB__AGX18527

SEQ ID NO: 29336 - protein, 466 aa, Artificial Sequence; identical to SEQ ID NO: 28635
  neuraminidase__InfluenzaB__AGX18538

SEQ ID NO: 29337 - protein, 466 aa, Artificial Sequence; identical to SEQ ID NO: 28635
  neuraminidase__InfluenzaB__AGX18549

SEQ ID NO: 29338 - protein, 466 aa, Artificial Sequence; identical to SEQ ID NO: 28635
  neuraminidase__InfluenzaB__AGX18560

SEQ ID NO: 29339 - protein, 466 aa, Artificial Sequence; identical to SEQ ID NO: 28635
  neuraminidase__InfluenzaB__AGX18571

SEQ ID NO: 29340 - protein, 466 aa, Artificial Sequence
  neuraminidase__InfluenzaB__AGX18582
MLPSTIQTLTLFLTSGGVLLSLYVLASLSYLLYSDILLKFSPTEITAPTMPLDCANASNVHAVNRSATKGVTLLLPEPEWAYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29341 - protein, 466 aa, Artificial Sequence; identical to SEQ ID NO: 28635
  neuraminidase__InfluenzaB__AGX18593

SEQ ID NO: 29342 - protein, 466 aa, Artificial Sequence; identical to SEQ ID NO: 28635
  neuraminidase__InfluenzaB__AGX18604

SEQ ID NO: 29343 - protein, 466 aa, Artificial Sequence
  neuraminidase__InfluenzaB__AGX18615
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGNKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29344 - protein, 466 aa, Artificial Sequence
  neuraminidase__InfluenzaB__AGX18626
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLILREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29345 - protein, 466 aa, Artificial Sequence; identical to SEQ ID NO: 28635
  neuraminidase__InfluenzaB__AGX18637

SEQ ID NO: 29346 - protein, 466 aa, Artificial Sequence; identical to SEQ ID NO: 28635
  neuraminidase__InfluenzaB__AGX18648

SEQ ID NO: 29347 - protein, 466 aa, Artificial Sequence; identical to SEQ ID NO: 28635
  neuraminidase__InfluenzaB__AGX18659

SEQ ID NO: 29348 - protein, 466 aa, Artificial Sequence; identical to SEQ ID NO: 28635
  neuraminidase__InfluenzaB__AGX18670

SEQ ID NO: 29349 - protein, 466 aa, Artificial Sequence
  neuraminidase__InfluenzaB__AGX18681
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIVREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29350 - protein, 466 aa, Artificial Sequence; identical to SEQ ID NO: 28635
  neuraminidase__InfluenzaB__AGX18692

SEQ ID NO: 29351 - protein, 466 aa, Artificial Sequence
  neuraminidase__InfluenzaB__AGX18703
MLPSTIQTLTLFLTSGGVLLSLYVSASLSYLLYSDILLKFPSTEITAPTMPLDCANASNVQAVNLSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALAFSGVMVSMEEPGWYSFGFEIKDKKCDVPCIGIEMVHDGGKETWHSAATAIYCLMGSGQLLWDTVTGVNMAL

SEQ ID NO: 29352 - protein, 466 aa, Artificial Sequence; identical to SEQ ID NO: 28635
  neuraminidase__InfluenzaB__AGX18714

SEQ ID NO: 29353 - protein, 466 aa, Artificial Sequence; identical to SEQ ID NO: 28635
  neuraminidase__InfluenzaB__AGX18725

SEQ ID NO: 29354 - protein, 466 aa, Artificial Sequence
  neuraminidase__InfluenzaB__AGX18736
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTGGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29355 - protein, 466 aa, Artificial Sequence; identical to SEQ ID NO: 28635
  neuraminidase__InfluenzaB__AGX18758

SEQ ID NO: 29356 - protein, 466 aa, Artificial Sequence; identical to SEQ ID NO: 28635
  neuraminidase__InfluenzaB__AGX18769

SEQ ID NO: 29357 - protein, 466 aa, Artificial Sequence; identical to SEQ ID NO: 29094
  neuraminidase__InfluenzaB__AGX18780

SEQ ID NO: 29358 - protein, 466 aa, Artificial Sequence; identical to SEQ ID NO: 28635
  neuraminidase__InfluenzaB__AGX18791

SEQ ID NO: 29359 - protein, 466 aa, Artificial Sequence; identical to SEQ ID NO: 28635
  neuraminidase__InfluenzaB__AGX18802

SEQ ID NO: 29360 - protein, 466 aa, Artificial Sequence
  neuraminidase__InfluenzaB__AGX18813
MLPSTIQTLTLFLTSGGVLLSLYVSASLSYLLYSDILLKFPSTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALVFSGVMVSMEEPGWYSFGFEIKDKKCDVPCIGIEMVHDGGKETWHSAATAIYCLMGSGQLLWDTVTGVNMAL

SEQ ID NO: 29361 - protein, 466 aa, Artificial Sequence; identical to SEQ ID NO: 29094
  neuraminidase__InfluenzaB__AGX18824

SEQ ID NO: 29362 - protein, 466 aa, Artificial Sequence
  neuraminidase__InfluenzaB__AGX18846
MLPSTIQTLTLFLTSGGVLLSLYVSASLSYLLYSDILLKFSPTEITAPTMPLDCANASNVQAVNRSATKGVTLLLSEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29363 - protein, 466 aa, Artificial Sequence; identical to SEQ ID NO: 28635
  neuraminidase__InfluenzaB__AGX18857

SEQ ID NO: 29364 - protein, 466 aa, Artificial Sequence; identical to SEQ ID NO: 29362
  neuraminidase__InfluenzaB__AGX18868

SEQ ID NO: 29365 - protein, 466 aa, Artificial Sequence; identical to SEQ ID NO: 29362
  neuraminidase__InfluenzaB__AGX18879

SEQ ID NO: 29366 - protein, 466 aa, Artificial Sequence
  neuraminidase__InfluenzaB__AGX18890
MLPSTIQTLTLFLTSGGVLLSLYVSASLSYLLYSDILLKFPSTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALAFSGVMVSMEEPGWYSFGFEIKDKKCDVPCIGIEMVHDGGKETWHSAATTIYCLMGSGQLLWDTVTGVNMAL

SEQ ID NO: 29367 - protein, 466 aa, Artificial Sequence; identical to SEQ ID NO: 28635
  neuraminidase__InfluenzaB__AGX18912

SEQ ID NO: 29368 - protein, 466 aa, Artificial Sequence
  neuraminidase__InfluenzaB__AGX18923
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNRTRGDRNKLRHLISVKLGKIPTVENSIFHMAAWSGSACHDGKEWIYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29369 - protein, 466 aa, Artificial Sequence; identical to SEQ ID NO: 28635
  neuraminidase__InfluenzaB__AGX18934

SEQ ID NO: 29370 - protein, 466 aa, Artificial Sequence
  neuraminidase__InfluenzaB__AGX18956
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHVAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29371 - protein, 466 aa, Artificial Sequence
  neuraminidase__InfluenzaB__AGX18967
MLPSTIQTLTLFLTSGGVLLSLYVSASLSYLLYSDILLKFSPTEITAPTMPLDCANASNVQAVNRSATKGVTPLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29372 - protein, 466 aa, Artificial Sequence; identical to SEQ ID NO: 29094
  neuraminidase__InfluenzaB__AGX18978

SEQ ID NO: 29373 - protein, 466 aa, Artificial Sequence
  neuraminidase__InfluenzaB__AGX18989
MLPSTIQTLTLFLTSGGVLLSLYVSASLSYLLYSDILLKFSPTEITAPTMPLDYANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRITKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29374 - protein, 466 aa, Artificial Sequence
  neuraminidase__InfluenzaB__AGX19000
MLPSTIQTLTLFLTSGGVLLSLYVSASLSYLLYSDILLKFSPTEITAPTMPLDCANASNVHAVNRSATKGVTLLLPEPEWTYPRLSCPGSTFQKALLISPHRFGETKGNSAPLIIREPFIACGPNECKHFALTYYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29375 - protein, 466 aa, Artificial Sequence; identical to SEQ ID NO: 28635
  neuraminidase__InfluenzaB__AGX19011

SEQ ID NO: 29376 - protein, 466 aa, Artificial Sequence; identical to SEQ ID NO: 28635
  neuraminidase__InfluenzaB__AGX19022

SEQ ID NO: 29377 - protein, 466 aa, Artificial Sequence
  neuraminidase__InfluenzaB__AGX19033
MLPSTIQTLTLFLTSGGVLLSLYVSASLSYLLYSDILLKFPSTEITAPTMPLNCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFVKLNVETDTAEIRLMCTETYLDTPRPDDGSITGPCESNGDKGSEGIKGGFVHQRMASKIGRWYSRTMSKTERMGMGLYVKYDGDPWADSDALAFSGVMVSMEEPGWYSFGFEIKDKKCDVPCIGIEMVHDGGKETWHSAATAIYCLMGSGQLLWDTVTGVNMAL

SEQ ID NO: 29378 - protein, 466 aa, Artificial Sequence; identical to SEQ ID NO: 28635
  neuraminidase__InfluenzaB__AGX19044

SEQ ID NO: 29379 - protein, 466 aa, Artificial Sequence; identical to SEQ ID NO: 28635
  neuraminidase__InfluenzaB__AGX19055

SEQ ID NO: 29380 - protein, 466 aa, Artificial Sequence
  neuraminidase__InfluenzaB__AGX19066
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWIYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29381 - protein, 466 aa, Artificial Sequence
  neuraminidase__InfluenzaB__AGX19077
MLPSTIQTLTLFLTSGGVLLSLYVSASLSYLLYSDILLKFTPTEITAPTMPLDCANASNVQAVNRSATKGVTPLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29382 - protein, 466 aa, Artificial Sequence
  neuraminidase__InfluenzaB__AGX19088
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIVKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29383 - protein, 466 aa, Artificial Sequence; identical to SEQ ID NO: 28635
  neuraminidase__InfluenzaB__AGX19099

SEQ ID NO: 29384 - protein, 466 aa, Artificial Sequence
  neuraminidase__InfluenzaB__AGX19110
MLPSTIQTLTLFLTSGGVLLSLYVSASLSYLLYSDILLKFPSTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIKHTEECTCGFASNKTIECACRDNSYTAKRPFIKLNVETDTAEIRLMCTETYLDTPRPDDGSITGPCESNGDKGSGGIKGGFVHQRMASKIGRWYSRTMSKTERMGMGLYVKYDGDPWADSDALVFSGVMVSMEEPGWYSFGFEIKDKKCDVPCIGIEMVHDGGKETWHSAATAIYCLMGSGQLLWDTVTGVNMAL

SEQ ID NO: 29385 - protein, 466 aa, Artificial Sequence
  neuraminidase__InfluenzaB__AGX19121
MLPSTTQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFRGVMVSMKEPGWYSFGFEIKDKKCDVPCIGIEMVHDGGKETWHSAATAIYCLMGSGQLLWDTVTGVDMAL

SEQ ID NO: 29386 - protein, 466 aa, Artificial Sequence; identical to SEQ ID NO: 29269
  neuraminidase__InfluenzaB__AGX19132

SEQ ID NO: 29387 - protein, 466 aa, Artificial Sequence; identical to SEQ ID NO: 29373
  neuraminidase__InfluenzaB__AGX19143

SEQ ID NO: 29388 - protein, 466 aa, Artificial Sequence
  neuraminidase__InfluenzaB__AGX19154
MLPSTIQTLTLFLTSGGVLLSLYVSASLSYLLYSNILLKFSPTEITAPTMPLDCANASNVHAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29389 - protein, 466 aa, Artificial Sequence; identical to SEQ ID NO: 28635
  neuraminidase__InfluenzaB__AGX19165

SEQ ID NO: 29390 - protein, 466 aa, Artificial Sequence
  neuraminidase__InfluenzaB__AGX19176
MLPSTIQTLTLFLTSGGVLLSLYVSASLSYLLYSDILLKFSPTEITAPTMPLDCANASNVHAVNRSATKGVTLLLPEPEWTYPRLSCPGSTFQKALLISPHRFGETKGNSAPLIIREPFIACGPNECKHFALTHYAAQPGGYYNRTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29391 - protein, 466 aa, Artificial Sequence
  neuraminidase__InfluenzaB__AGX19187
MLPSTIQTLTLFLTSGGVLLSLYVSASLSYLLYSDILLKFSPTEITAPTMPLDCANASNVQAVNRSATKGVTLLLPEPEWTYPRLSCSGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29392 - protein, 466 aa, Artificial Sequence
  neuraminidase__InfluenzaB__AGX19198
MLPSTIQTLTLFLTSGGVLLSLYVSASLSYLLYSDILLKFSPTEITAPTMPLDYANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29393 - protein, 466 aa, Artificial Sequence; identical to SEQ ID NO: 29373
  neuraminidase__InfluenzaB__AGX19209

SEQ ID NO: 29394 - protein, 466 aa, Artificial Sequence
  neuraminidase__InfluenzaB__AGX19220
MLPSTIQTLTLFLTSGGVLLSLYVSASLSYLLYSDILLKFSPTEITAPTMSLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDRGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29395 - protein, 466 aa, Artificial Sequence; identical to SEQ ID NO: 28841
  neuraminidase__InfluenzaB__AGX19231

SEQ ID NO: 29396 - protein, 466 aa, Artificial Sequence
  neuraminidase__InfluenzaB__AGX19253
MLPSTIQTLTLFLTSGGVLLSLYVSASLSYLLYSDILLKFSPTEITAPTMPLDCANASNVQAVNHSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDSLAFSGVMVSMKEPGWYSFGFEIKDKKCDVPCIGIEMVHDGGKETWHSAATAIYCLMGSGQLLWDTVTGVDMAL

SEQ ID NO: 29397 - protein, 466 aa, Artificial Sequence; identical to SEQ ID NO: 29371
  neuraminidase__InfluenzaB__AGX19264

SEQ ID NO: 29398 - protein, 466 aa, Artificial Sequence; identical to SEQ ID NO: 28635
  neuraminidase__InfluenzaB__AGX19275

SEQ ID NO: 29399 - protein, 466 aa, Artificial Sequence
  neuraminidase__InfluenzaB__AGX19286
MIPSTIQTLTLFLTSGGVLLSLYVSASLSYLLYSDILLKFSPTEIIAPTMPLDCANASNVHAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29400 - protein, 466 aa, Artificial Sequence
  neuraminidase__InfluenzaB__AGX19297
MLPSTIQTLTLFLTSGGVLLSLYVSASLSYLLYSDILLKFSPTEIIAPTMPLDCANASNVHAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29401 - protein, 466 aa, Artificial Sequence; identical to SEQ ID NO: 29400
  neuraminidase__InfluenzaB__AGX19308

SEQ ID NO: 29402 - protein, 466 aa, Artificial Sequence; identical to SEQ ID NO: 29400
  neuraminidase__InfluenzaB__AGX19319

SEQ ID NO: 29403 - protein, 466 aa, Artificial Sequence
  neuraminidase__InfluenzaB__AGX19330
MLPSTIQTLTLFLTSGGVLLSLYVSASLSYLLYSDILLKFSPTEIIAPTMPLDCANASNVHAVNRSATKGVTLLLPEPEWTYPRLSCPGSTFQKALLISPHRFGETKGNSAPLIIREPFIACGPNECKHFALTHYAAQPGGYYNGTRGNRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29404 - protein, 466 aa, Artificial Sequence; identical to SEQ ID NO: 29400
  neuraminidase__InfluenzaB__AGX19341

SEQ ID NO: 29405 - protein, 466 aa, Artificial Sequence; identical to SEQ ID NO: 29400
  neuraminidase__InfluenzaB__AGX19352

SEQ ID NO: 29406 - protein, 466 aa, Artificial Sequence
  neuraminidase__InfluenzaB__AGX19363
MLPSTIQTLTLFLTSGGVLLSLYVSASLSYLLYSDILLKFSPTEIIAPTMPLDCANASNVHAVNRSATKGVTLLLPEPEWTYPRLSCPGSTFQKALLISPHRFGETKGNSAPLIIREPFIACGPNECKHFALTYYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29407 - protein, 466 aa, Artificial Sequence
  neuraminidase__InfluenzaB__AGX19374
MLPSTIQTLTLFLTSGGVLLSLYVSASLSYLLYSDILLKFSQTEITAPIMPLDCANASNVQAVNRSAAKGVTLLLSEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGVSECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29408 - protein, 466 aa, Artificial Sequence; identical to SEQ ID NO: 29400
  neuraminidase__InfluenzaB__AGX19385

SEQ ID NO: 29409 - protein, 466 aa, Artificial Sequence
  neuraminidase__InfluenzaB__AGX19396
MLPSTIQTLTLFLTSGGVLLSLYVSASLSYLLYSDILLKFSPTEIIAPTMPLDCANASNVHAVNRSATKGVTLLLPEPEWTYPRLSCPGSTFQKALLISPHRFGETKGNSAPLIIREPFIACGPNECKHFALTHYAAQPGGYYNGPRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29410 - protein, 466 aa, Artificial Sequence; identical to SEQ ID NO: 29400
  neuraminidase__InfluenzaB__AGX19407

SEQ ID NO: 29411 - protein, 466 aa, Artificial Sequence; identical to SEQ ID NO: 28961
  neuraminidase__InfluenzaB__AGX19418

SEQ ID NO: 29412 - protein, 466 aa, Artificial Sequence
  neuraminidase__InfluenzaB__AGX19429
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTRRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29413 - protein, 466 aa, Artificial Sequence
  neuraminidase__InfluenzaB__AGX19451
MLPSTIQTLTLFLTSGGVLLSLYVSASLSYLLYSDILLKFSPTEITAPTMPLDCANASNVHAVNHSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMVTDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29414 - protein, 466 aa, Artificial Sequence; identical to SEQ ID NO: 29412
  neuraminidase__InfluenzaB__AGX19462

SEQ ID NO: 29415 - protein, 466 aa, Artificial Sequence; identical to SEQ ID NO: 29412
  neuraminidase__InfluenzaB__AGX19473

SEQ ID NO: 29416 - protein, 466 aa, Artificial Sequence; identical to SEQ ID NO: 28961
  neuraminidase__InfluenzaB__AGX19484

SEQ ID NO: 29417 - protein, 466 aa, Artificial Sequence; identical to SEQ ID NO: 29413
  neuraminidase__InfluenzaB__AGX19495

SEQ ID NO: 29418 - protein, 466 aa, Artificial Sequence; identical to SEQ ID NO: 28961
  neuraminidase__InfluenzaB__AGX19506

SEQ ID NO: 29419 - protein, 466 aa, Artificial Sequence; identical to SEQ ID NO: 28961
  neuraminidase__InfluenzaB__AGX19517

SEQ ID NO: 29420 - protein, 466 aa, Artificial Sequence; identical to SEQ ID NO: 28961
  neuraminidase__InfluenzaB__AGX19528

SEQ ID NO: 29421 - protein, 466 aa, Artificial Sequence; identical to SEQ ID NO: 29413
  neuraminidase__InfluenzaB__AGX19539

SEQ ID NO: 29422 - protein, 466 aa, Artificial Sequence
  neuraminidase__InfluenzaB__AGX19550
MLPSTIQTLTLFLTSGGVLLSLYVSASLSYLLYSDILLKFSPTEITAPTMPLDCANASNVHAVNHSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMVTDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMNEPGWYSFGFEIKDKKCDVPCIGIEMVHDGGKETWHSAATAIYCLMGSGQLLWDTVTGVDMAL

SEQ ID NO: 29423 - protein, 466 aa, Artificial Sequence
  neuraminidase__InfluenzaB__AGX19561
MLPSTIQTLTLFLTSGGVLLSLYVSASLSYLLYSDILLKFSPTEITAPTMPLDCANASNVHAVNHSATKGVTLLLPEPEWTYPRLSCPGSTFQKALLISPHRFGETKGNSAPLIIREPFIACGPNECKHFALTHYAAQPRGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMVTDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29424 - protein, 466 aa, Artificial Sequence
  neuraminidase__InfluenzaB__AGX19572
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVNMAL

SEQ ID NO: 29425 - protein, 466 aa, Artificial Sequence; identical to SEQ ID NO: 28961
  neuraminidase__InfluenzaB__AGX19583

SEQ ID NO: 29426 - protein, 466 aa, Artificial Sequence; identical to SEQ ID NO: 28961
  neuraminidase__InfluenzaB__AGX19594

SEQ ID NO: 29427 - protein, 466 aa, Artificial Sequence; identical to SEQ ID NO: 28961
  neuraminidase__InfluenzaB__AGX19605

SEQ ID NO: 29428 - protein, 466 aa, Artificial Sequence; identical to SEQ ID NO: 28961
  neuraminidase__InfluenzaB__AGX19616

SEQ ID NO: 29429 - protein, 466 aa, Artificial Sequence; identical to SEQ ID NO: 29413
  neuraminidase__InfluenzaB__AGX19627

SEQ ID NO: 29430 - protein, 466 aa, Artificial Sequence; identical to SEQ ID NO: 28961
  neuraminidase__InfluenzaB__AGX19638

SEQ ID NO: 29431 - protein, 466 aa, Artificial Sequence; identical to SEQ ID NO: 29413
  neuraminidase__InfluenzaB__AGX19649

SEQ ID NO: 29432 - protein, 466 aa, Artificial Sequence; identical to SEQ ID NO: 29413
  neuraminidase__InfluenzaB__AGX19660

SEQ ID NO: 29433 - protein, 466 aa, Artificial Sequence; identical to SEQ ID NO: 28961
  neuraminidase__InfluenzaB__AGX19671

SEQ ID NO: 29434 - protein, 466 aa, Artificial Sequence; identical to SEQ ID NO: 28961
  neuraminidase__InfluenzaB__AGX19682

SEQ ID NO: 29435 - protein, 466 aa, Artificial Sequence; identical to SEQ ID NO: 29413
  neuraminidase__InfluenzaB__AGX19704

SEQ ID NO: 29436 - protein, 466 aa, Artificial Sequence
  neuraminidase__InfluenzaB__AGX19715
MLPSTIQTLTLFLTSGGVLLSLYVSASLSYLLYSDILLKFSPTEITAPTMPLDCANASNVHAVNRSTTKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29437 - protein, 466 aa, Artificial Sequence; identical to SEQ ID NO: 28961
  neuraminidase__InfluenzaB__AGX19726

SEQ ID NO: 29438 - protein, 466 aa, Artificial Sequence; identical to SEQ ID NO: 28961
  neuraminidase__InfluenzaB__AGX19737

SEQ ID NO: 29439 - protein, 466 aa, Artificial Sequence; identical to SEQ ID NO: 28961
  neuraminidase__InfluenzaB__AGX19748

SEQ ID NO: 29440 - protein, 466 aa, Artificial Sequence; identical to SEQ ID NO: 29413
  neuraminidase__InfluenzaB__AGX19759

SEQ ID NO: 29441 - protein, 466 aa, Artificial Sequence; identical to SEQ ID NO: 28961
  neuraminidase__InfluenzaB__AGX19770

SEQ ID NO: 29442 - protein, 466 aa, Artificial Sequence; identical to SEQ ID NO: 28961
  neuraminidase__InfluenzaB__AGX19781

SEQ ID NO: 29443 - protein, 466 aa, Artificial Sequence; identical to SEQ ID NO: 28961
  neuraminidase__InfluenzaB__AGX19792

SEQ ID NO: 29444 - protein, 466 aa, Artificial Sequence; identical to SEQ ID NO: 28961
  neuraminidase__InfluenzaB__AGX19803

SEQ ID NO: 29445 - protein, 466 aa, Artificial Sequence; identical to SEQ ID NO: 28961
  neuraminidase__InfluenzaB__AGX19814

SEQ ID NO: 29446 - protein, 466 aa, Artificial Sequence
  neuraminidase__InfluenzaB__AGX19825
MLPSTIQTLTLFLTSGGVLLSLYVSASLSYLLYSDILLKFSPTEITAPTMPLDCANASNVHAVNHSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMVTDGSASGVSECRFLKIREGRIIKEIFPTGRVKHTEECTCGFANNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29447 - protein, 466 aa, Artificial Sequence; identical to SEQ ID NO: 28961
  neuraminidase__InfluenzaB__AGX19836

SEQ ID NO: 29448 - protein, 466 aa, Artificial Sequence; identical to SEQ ID NO: 28961
  neuraminidase__InfluenzaB__AGX19847

SEQ ID NO: 29449 - protein, 466 aa, Artificial Sequence; identical to SEQ ID NO: 28961
  neuraminidase__InfluenzaB__AGX19858

SEQ ID NO: 29450 - protein, 466 aa, Artificial Sequence; identical to SEQ ID NO: 28961
  neuraminidase__InfluenzaB__AGX19869

SEQ ID NO: 29451 - protein, 466 aa, Artificial Sequence; identical to SEQ ID NO: 28961
  neuraminidase__InfluenzaB__AGX19880

SEQ ID NO: 29452 - protein, 466 aa, Artificial Sequence; identical to SEQ ID NO: 28961
  neuraminidase__InfluenzaB__AGX19891

SEQ ID NO: 29453 - protein, 466 aa, Artificial Sequence; identical to SEQ ID NO: 28961
  neuraminidase__InfluenzaB__AGX19902

SEQ ID NO: 29454 - protein, 466 aa, Artificial Sequence
  neuraminidase__InfluenzaB__AGX19913
MLPSTIQTLTLFLTSGGVLLSLYVSASLSYLLYSDILLKFSPTEITAPTMPLDCANASNVHAMNHSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMVTDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29455 - protein, 466 aa, Artificial Sequence; identical to SEQ ID NO: 28961
  neuraminidase__InfluenzaB__AGX19924

SEQ ID NO: 29456 - protein, 466 aa, Artificial Sequence; identical to SEQ ID NO: 28961
  neuraminidase__InfluenzaB__AGX19935

SEQ ID NO: 29457 - protein, 466 aa, Artificial Sequence; identical to SEQ ID NO: 28961
  neuraminidase__InfluenzaB__AGX19946

SEQ ID NO: 29458 - protein, 466 aa, Artificial Sequence; identical to SEQ ID NO: 28961
  neuraminidase__InfluenzaB__AGX19957

SEQ ID NO: 29459 - protein, 466 aa, Artificial Sequence
  neuraminidase__InfluenzaB__AGX19968
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVNMAL

SEQ ID NO: 29460 - protein, 466 aa, Artificial Sequence; identical to SEQ ID NO: 29413
  neuraminidase__InfluenzaB__AGX19979

SEQ ID NO: 29461 - protein, 466 aa, Artificial Sequence; identical to SEQ ID NO: 29413
  neuraminidase__InfluenzaB__AGX19990

SEQ ID NO: 29462 - protein, 466 aa, Artificial Sequence; identical to SEQ ID NO: 28961
  neuraminidase__InfluenzaB__AGX20001

SEQ ID NO: 29463 - protein, 466 aa, Artificial Sequence; identical to SEQ ID NO: 28961
  neuraminidase__InfluenzaB__AGX20012

SEQ ID NO: 29464 - protein, 466 aa, Artificial Sequence; identical to SEQ ID NO: 28961
  neuraminidase__InfluenzaB__AGX20023

SEQ ID NO: 29465 - protein, 466 aa, Artificial Sequence; identical to SEQ ID NO: 28961
  neuraminidase__InfluenzaB__AGX20034

SEQ ID NO: 29466 - protein, 466 aa, Artificial Sequence; identical to SEQ ID NO: 28961
  neuraminidase__InfluenzaB__AGX20045

SEQ ID NO: 29467 - protein, 466 aa, Artificial Sequence
  neuraminidase__InfluenzaB__AGX20056
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLMIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMVTDGSASGVSECRFLKIREGRIIKEIFPTGRVKHTEECTCGFASNKTIECACRDNSYTAKRPFVKLNVETDTAEIRLMCTDTYLDTPRPNDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29468 - protein, 466 aa, Artificial Sequence
  neuraminidase__InfluenzaB__AGX20067
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMVTDGSASGVSECRFLKIREGRIIKEIFPTGRVKHTEECTCGFASNKTIECACRDNSYTAKRPFVKLNVETDTAEIRLMCTDTYLDTPRPNDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29469 - protein, 466 aa, Artificial Sequence; identical to SEQ ID NO: 28961
  neuraminidase__InfluenzaB__AGX20078

SEQ ID NO: 29470 - protein, 466 aa, Artificial Sequence; identical to SEQ ID NO: 28961
  neuraminidase__InfluenzaB__AGX20089

SEQ ID NO: 29471 - protein, 466 aa, Artificial Sequence
  neuraminidase__InfluenzaB__AGX20100
MLPSTIQTLTLFLTSGGVLLSLYVSASLSYLLYSDILLKFPSTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNAVLKIKYGEAYTDTYHSYANNILRTQESACNCIGGNCYLMITDGSASGVSECRFLKIREGRIIKEIFPTGRIQHTEECTCGFASNKTIECACRDNSYTAKRPFVKLNVETDTAEIRLMCTKTYLDTPRPDDGSITGPCESNGGKGSGGIKGGFVHQRMASKIGRWYSRTMSKTERKGMGLYVKYDGDPWADSDALAFSGVMVSMEEPGWYSFGFEIKDKKCDVPCIGIEMVHDGGKETWHSAATAIYCLMGSGQLLWDTVTGVNMAL

SEQ ID NO: 29472 - protein, 466 aa, Artificial Sequence
  neuraminidase__InfluenzaB__AGX20111
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALTFSGVMVSMKEPGWYSFGFEIKDKKCDVPCIGIEMVHDGGKETWHSAATAIYCLMGSGQLLWDTVTGVDMAL

SEQ ID NO: 29473 - protein, 466 aa, Artificial Sequence
  neuraminidase__InfluenzaB__AGX20122
MLPSTIQTLTLFLTSGGVLLSLYVSALLSYLLYSDILLKFSPTEITAPTMSLDCANASNVQAVNRSATKGVTFLLPEPEWTYPRLSCPGSTFQRALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29474 - protein, 466 aa, Artificial Sequence
  neuraminidase__InfluenzaB__AGX20133
MLPSTIQTLTLFLTSGGVLLSLYVSALLSYLLYSDVLLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29475 - protein, 466 aa, Artificial Sequence
  neuraminidase__InfluenzaB__AGX20144
MLPSTIQTLTLFLTSGGVLLSLYVSALLSYLLYSDILLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGISECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29476 - protein, 466 aa, Artificial Sequence; identical to SEQ ID NO: 29475
  neuraminidase__InfluenzaB__AGX20155

SEQ ID NO: 29477 - protein, 466 aa, Artificial Sequence; identical to SEQ ID NO: 29475
  neuraminidase__InfluenzaB__AGX20166

SEQ ID NO: 29478 - protein, 466 aa, Artificial Sequence; identical to SEQ ID NO: 28895
  neuraminidase__InfluenzaB__AGX20177

SEQ ID NO: 29479 - protein, 466 aa, Artificial Sequence; identical to SEQ ID NO: 28895
  neuraminidase__InfluenzaB__AGX20188

SEQ ID NO: 29480 - protein, 466 aa, Artificial Sequence; identical to SEQ ID NO: 28872
  neuraminidase__InfluenzaB__AGX20199

SEQ ID NO: 29481 - protein, 466 aa, Artificial Sequence; identical to SEQ ID NO: 28895
  neuraminidase__InfluenzaB__AGX20210

SEQ ID NO: 29482 - protein, 466 aa, Artificial Sequence; identical to SEQ ID NO: 29475
  neuraminidase__InfluenzaB__AGX20221

SEQ ID NO: 29483 - protein, 466 aa, Artificial Sequence
  neuraminidase__InfluenzaB__AGX20232
MLPSTIQTLTLFLTSGGVLLSLYVSASLSYLLYSGILLKFSPTEITAPTMPLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNETIECACRDNSYTAKRPFVKLNVETDTAEIRLMCTDTYLDTPRPNDGSITGPCESNGDKGGGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29484 - protein, 466 aa, Artificial Sequence; identical to SEQ ID NO: 28895
  neuraminidase__InfluenzaB__AGX20243

SEQ ID NO: 29485 - protein, 466 aa, Artificial Sequence; identical to SEQ ID NO: 29475
  neuraminidase__InfluenzaB__AGX20254

SEQ ID NO: 29486 - protein, 466 aa, Artificial Sequence; identical to SEQ ID NO: 28872
  neuraminidase__InfluenzaB__AGX20265

SEQ ID NO: 29487 - protein, 466 aa, Artificial Sequence; identical to SEQ ID NO: 29475
  neuraminidase__InfluenzaB__AGX20276

SEQ ID NO: 29488 - protein, 466 aa, Artificial Sequence; identical to SEQ ID NO: 28895
  neuraminidase__InfluenzaB__AGX20287

SEQ ID NO: 29489 - protein, 466 aa, Artificial Sequence
  neuraminidase__InfluenzaB__AGX20298
MLPSTIQTLTLFLTSGGVLLSLYVSALLSYLLYSDILLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWQSAATAIYCLMGSGQLLWDTVTGVDMAL

SEQ ID NO: 29490 - protein, 466 aa, Artificial Sequence; identical to SEQ ID NO: 28872
  neuraminidase__InfluenzaB__AGX20320

SEQ ID NO: 29491 - protein, 466 aa, Artificial Sequence; identical to SEQ ID NO: 28895
  neuraminidase__InfluenzaB__AGX20331

SEQ ID NO: 29492 - protein, 466 aa, Artificial Sequence
  neuraminidase__InfluenzaB__AGX20342
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMVTDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29493 - protein, 466 aa, Artificial Sequence
  neuraminidase__InfluenzaB__AGX20353
MLPSTIQTLTLFLTSGGVLLSLYVSALLSYLLYSDILLKFSPTEIIAPTMSLDCANASNVQAVNRSATKGVTFLLPEPEWTYPRLSCPGSTFQKALLISPHRFGETKGNSAPLIIREPFIACGPNECKHFALTHYAAQPGGYYNRTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGISECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29494 - protein, 466 aa, Artificial Sequence; identical to SEQ ID NO: 28895
  neuraminidase__InfluenzaB__AGX20364

SEQ ID NO: 29495 - protein, 466 aa, Artificial Sequence; identical to SEQ ID NO: 28890
  neuraminidase__InfluenzaB__AGX20375

SEQ ID NO: 29496 - protein, 466 aa, Artificial Sequence
  neuraminidase__InfluenzaB__AGX20386
MLPSTIQTLTLFLTSGGVLLSLYVSALLSYLLYSDILLKFSPTEITAPTMSLDCANASNVQAVNRSATKGVTFLLPEPEWTHPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGISECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29497 - protein, 466 aa, Artificial Sequence; identical to SEQ ID NO: 28895
  neuraminidase__InfluenzaB__AGX20397

SEQ ID NO: 29498 - protein, 466 aa, Artificial Sequence; identical to SEQ ID NO: 28890
  neuraminidase__InfluenzaB__AGX20408

SEQ ID NO: 29499 - protein, 466 aa, Artificial Sequence; identical to SEQ ID NO: 28872
  neuraminidase__InfluenzaB__AGX20419

SEQ ID NO: 29500 - protein, 466 aa, Artificial Sequence
  neuraminidase__InfluenzaB__AGX20430
MLPSTIQTLTLFLTSGGVLLSLYVSALLSYLLYSDILLKFSPTEITAPTMSLDCANASNVQAVNRSATKGVTFLLPEPEWTYPRLSCPGSTFQRALLISPHRFGEAKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29501 - protein, 466 aa, Artificial Sequence; identical to SEQ ID NO: 28872
  neuraminidase__InfluenzaB__AGX20441

SEQ ID NO: 29502 - protein, 466 aa, Artificial Sequence
  neuraminidase__InfluenzaB__AGX20452
MLPSTIQTLTLFLTSGGVLLSLYVSASLSYLLYSDILLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIRDKKCDVPCIGIEMVHDGGKETWHSAATAIYCLMGSGQLLWDTVTGVDMAL

SEQ ID NO: 29503 - protein, 466 aa, Artificial Sequence; identical to SEQ ID NO: 28895
  neuraminidase__InfluenzaB__AGX20463

SEQ ID NO: 29504 - protein, 466 aa, Artificial Sequence; identical to SEQ ID NO: 28895
  neuraminidase__InfluenzaB__AGX20474

SEQ ID NO: 29505 - protein, 466 aa, Artificial Sequence; identical to SEQ ID NO: 28895
  neuraminidase__InfluenzaB__AGX20485

SEQ ID NO: 29506 - protein, 466 aa, Artificial Sequence; identical to SEQ ID NO: 29475
  neuraminidase__InfluenzaB__AGX20496

SEQ ID NO: 29507 - protein, 466 aa, Artificial Sequence; identical to SEQ ID NO: 28895
  neuraminidase__InfluenzaB__AGX20507

SEQ ID NO: 29508 - protein, 466 aa, Artificial Sequence; identical to SEQ ID NO: 28895
  neuraminidase__InfluenzaB__AGX20518

SEQ ID NO: 29509 - protein, 466 aa, Artificial Sequence
  neuraminidase__InfluenzaB__AGX20529
MLPSTIQTLTLFLTSGGVLLSLYVSALLSYLLYSDILLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECTCRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29510 - protein, 466 aa, Artificial Sequence; identical to SEQ ID NO: 29473
  neuraminidase__InfluenzaB__AGX20540

SEQ ID NO: 29511 - protein, 466 aa, Artificial Sequence; identical to SEQ ID NO: 29119
  neuraminidase__InfluenzaB__AGX20551

SEQ ID NO: 29512 - protein, 466 aa, Artificial Sequence; identical to SEQ ID NO: 28872
  neuraminidase__InfluenzaB__AGX20562

SEQ ID NO: 29513 - protein, 466 aa, Artificial Sequence; identical to SEQ ID NO: 28895
  neuraminidase__InfluenzaB__AGX20573

SEQ ID NO: 29514 - protein, 466 aa, Artificial Sequence
  neuraminidase__InfluenzaB__AGX20584
MLPSTIQTLTLFLTSGGVLLSLYVSASLSYLLYSDILLKFSSTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESNGDKGSGGIKGGFVHQRMESRIGRWYSRTMSKTERMGMGLYVKYDGDPWTDSDALTFSGVMVSMKEPGWYSFGFEIKDKKCDVPCIGIEMVHDGGKETWHSAATAIYCLMGSGQLLWDTVTGVDMAL

SEQ ID NO: 29515 - protein, 466 aa, Artificial Sequence; identical to SEQ ID NO: 28895
  neuraminidase__InfluenzaB__AGX20595

SEQ ID NO: 29516 - protein, 466 aa, Artificial Sequence; identical to SEQ ID NO: 29473
  neuraminidase__InfluenzaB__AGX20606

SEQ ID NO: 29517 - protein, 466 aa, Artificial Sequence; identical to SEQ ID NO: 29473
  neuraminidase__InfluenzaB__AGX20617

SEQ ID NO: 29518 - protein, 466 aa, Artificial Sequence; identical to SEQ ID NO: 29500
  neuraminidase__InfluenzaB__AGX20628

SEQ ID NO: 29519 - protein, 466 aa, Artificial Sequence; identical to SEQ ID NO: 28900
  neuraminidase__InfluenzaB__AGX20639

SEQ ID NO: 29520 - protein, 466 aa, Artificial Sequence
  neuraminidase__InfluenzaB__AGX20650
MLPSTIQTLTLFLTSGGVLLSLYVSALLSYLLYSDILLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESTCNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29521 - protein, 466 aa, Artificial Sequence
  neuraminidase__InfluenzaB__AGX20661
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVNLGKIPTVENSIFHMAAWSGSACHDGKEWTYIGVDGPDNNALLKVKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESNGDKGSGGIKGGFVHQRMESKIGRWYSRTMSKTERMGMGLYVKYDGDPWTDSDALAFSGVMVSMKEPGWYSFGFEIKDKKCDVPCIGIEMVHDGGKETWHSAATAIYCLMGSGQLLWDTVTGVDMAL

SEQ ID NO: 29522 - protein, 466 aa, Artificial Sequence; identical to SEQ ID NO: 28956
  neuraminidase__InfluenzaB__AGX20683

SEQ ID NO: 29523 - protein, 466 aa, Artificial Sequence; identical to SEQ ID NO: 29119
  neuraminidase__InfluenzaB__AGX20694

SEQ ID NO: 29524 - protein, 466 aa, Artificial Sequence
  neuraminidase__InfluenzaB__AGX20705
MLPSTIQTLTLFLTSGGVLLSLYVSASLSYLLYSGILLKFSPTEITAPTMPLDCANASDVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESNGDKGSGGIKGGFVHQRMESKIGRWYSRTMSKTERMGMGLYVKYDGDPWADSDALTFSGVMVSMKEPGWYSFGFEIKDKKCDVPCIGIEMVHDGGKETWHSAATAIYCLMGSGQLLWDTVTGVDMAL

SEQ ID NO: 29525 - protein, 466 aa, Artificial Sequence
  neuraminidase__InfluenzaB__AGX20716
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRIESRIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29526 - protein, 466 aa, Artificial Sequence
  neuraminidase__InfluenzaB__AGX20727
MLPSTIQTLTLFLTSGGVLLSLYVSALLSYLLYSDILLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSTTGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29527 - protein, 466 aa, Artificial Sequence; identical to SEQ ID NO: 29119
  neuraminidase__InfluenzaB__AGX20738

SEQ ID NO: 29528 - protein, 466 aa, Artificial Sequence; identical to SEQ ID NO: 28895
  neuraminidase__InfluenzaB__AGX20749

SEQ ID NO: 29529 - protein, 466 aa, Artificial Sequence
  neuraminidase__InfluenzaB__AGX20760
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRMESRIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29530 - protein, 466 aa, Artificial Sequence; identical to SEQ ID NO: 28895
  neuraminidase__InfluenzaB__AGX20771

SEQ ID NO: 29531 - protein, 466 aa, Artificial Sequence
  neuraminidase__InfluenzaB__AGX20782
MLPSTIQTLTLFLTSGGVLLSLYVSASLSYLLYSDILLKFSPTEITAPTMPLDCANASNVQAVNHSATKGVTLLLPEPEWTYPRLSCPGSTFQKALLISSHRFGETKGNSAPLIIREPFVACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRMESKIGRWYSRTMSRTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29532 - protein, 466 aa, Artificial Sequence
  neuraminidase__InfluenzaB__AGX20793
MLPSTIQTLTLFLTSGGVLLSLYVSALLSYLLYSDILLKFSPTEITAPTMSLDCANTSNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVNMAL

SEQ ID NO: 29533 - protein, 466 aa, Artificial Sequence
  neuraminidase__InfluenzaB__AGX20804
MLPSTIQTLTLFITSGGVLLSLYVSALLSYLLYSDILLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29534 - protein, 466 aa, Artificial Sequence; identical to SEQ ID NO: 28956
  neuraminidase__InfluenzaB__AGX20815

SEQ ID NO: 29535 - protein, 466 aa, Artificial Sequence; identical to SEQ ID NO: 28956
  neuraminidase__InfluenzaB__AGX20826

SEQ ID NO: 29536 - protein, 466 aa, Artificial Sequence; identical to SEQ ID NO: 28956
  neuraminidase__InfluenzaB__AGX20837

SEQ ID NO: 29537 - protein, 466 aa, Artificial Sequence; identical to SEQ ID NO: 28956
  neuraminidase__InfluenzaB__AGX20848

SEQ ID NO: 29538 - protein, 466 aa, Artificial Sequence
  neuraminidase__InfluenzaB__AGX20870
MLPSTIQMLTLFLTSGGVLLSLYVSASLSYLLYSDILLKFSPTEITAPTMPLDCANASNVHAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERKGMGLYVKYDGEPWTDSDALAFRGVMVSMKEPGWYSFGFEIKDKKCDVPCIGIEMVHDGGKETWHSAATAIYCLMGSGQLLWDTVTGVDMAL

SEQ ID NO: 29539 - protein, 466 aa, Artificial Sequence
  neuraminidase__InfluenzaB__AGX20881
MLPSTIQMLTLFLTSGGVLLSLYVSASLSYLLYSDILLKFSPTEITAPTMPLDCANASNVHAVNRSATKGVTFLLPEPEWTYPRLSCPGSTFQKALLISPHRFGETKGNSAPLIIREPFIACGPNECKHFALTHYAAQPGGYYNGTRGNRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERKGMGLYVKYDGDPWTDSDALAFRGVMVSMKEPGWYSFGFEIKDKKCDVPCIGIEMVHDGGKETWHSAATAIYCLMGSGQLLWDTVTGVDMAL

SEQ ID NO: 29540 - protein, 466 aa, Artificial Sequence
  neuraminidase__InfluenzaB__AGX20892
MLPSTIQTLTLFLTSGGVLLSLYVSALLSYLLYSDILLKFSPTEITAPTMSLDCANASNVQAVNRSATKGVTFLLPEPEWTYPRLSCPGSTFQRALLISPHRFGEAKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEILPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29541 - protein, 466 aa, Artificial Sequence; identical to SEQ ID NO: 28956
  neuraminidase__InfluenzaB__AGX20903

SEQ ID NO: 29542 - protein, 466 aa, Artificial Sequence; identical to SEQ ID NO: 28956
  neuraminidase__InfluenzaB__AGX20914

SEQ ID NO: 29543 - protein, 466 aa, Artificial Sequence
  neuraminidase__InfluenzaB__AGX20925
MLPSTIQTLTLFLTSGGVLLSLYVSALLSYLLYSDILLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIQEGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29544 - protein, 466 aa, Artificial Sequence
  neuraminidase__InfluenzaB__AGX20936
MLPSTIQTLTLFLTSGGVLLSLYVSALLSYLLYSDILPKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALVFSGVMVSMKEPGWYSFGFEIKDKKCDVPCIGIEMVHDGGKETWHSAATAIYCLMGSGQLLWDTVTGVDMAL

SEQ ID NO: 29545 - protein, 466 aa, Artificial Sequence; identical to SEQ ID NO: 28895
  neuraminidase__InfluenzaB__AGX20947

SEQ ID NO: 29546 - protein, 466 aa, Artificial Sequence
  neuraminidase__InfluenzaB__AGX20958
MLPSTIQTLTLFLTSGGVLLSLYVSALLSYLLYSDILLKFSPTEITTPTMSLDCTNASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIQEGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29547 - protein, 466 aa, Artificial Sequence; identical to SEQ ID NO: 29119
  neuraminidase__InfluenzaB__AGX20969

SEQ ID NO: 29548 - protein, 466 aa, Artificial Sequence; identical to SEQ ID NO: 29532
  neuraminidase__InfluenzaB__AGX20980

SEQ ID NO: 29549 - protein, 466 aa, Artificial Sequence
  neuraminidase__InfluenzaB__AGX20991
MLPSTIQTLTLFLTSGGVLLSLYVSALLSYLLYSDILPKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIRKGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALVFSGVMVSMKEPGWYSFGFEIKDKKCDVPCIGIEMVHDGGKETWHSAATAIYCLMGSGQLLWDTVTGVDMAL

SEQ ID NO: 29550 - protein, 466 aa, Artificial Sequence; identical to SEQ ID NO: 28956
  neuraminidase__InfluenzaB__AGX21002

SEQ ID NO: 29551 - protein, 466 aa, Artificial Sequence
  neuraminidase__InfluenzaB__AGX21013
MLPSTIQTLTLFLTSGGVLLSLYVSALLSYLLYSDILLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTNTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29552 - protein, 466 aa, Artificial Sequence
  neuraminidase__InfluenzaB__AGX21024
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPNRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEVRLMCTDTYLDTPRPNDGSITGPCESDGDKGSGGIKGGFVHQRMESKIGRWYSRTMSKTERMGMGLYVKYDGDPWADSDALTFSGVMVSMKEPGWYSFGFEIKDKKCDVPCIGIEMVHDGGKETWHSAATAIYCLMGSGQLLWDTVTGVDMAL

SEQ ID NO: 29553 - protein, 466 aa, Artificial Sequence; identical to SEQ ID NO: 28956
  neuraminidase__InfluenzaB__AGX21035

SEQ ID NO: 29554 - protein, 466 aa, Artificial Sequence; identical to SEQ ID NO: 29119
  neuraminidase__InfluenzaB__AGX21046

SEQ ID NO: 29555 - protein, 466 aa, Artificial Sequence; identical to SEQ ID NO: 29122
  neuraminidase__InfluenzaB__AGX21057

SEQ ID NO: 29556 - protein, 466 aa, Artificial Sequence; identical to SEQ ID NO: 29540
  neuraminidase__InfluenzaB__AGX21068

SEQ ID NO: 29557 - protein, 466 aa, Artificial Sequence
  neuraminidase__InfluenzaB__AGX21079
MLPSTIQTLTLFLTSGGVLLSLYVSASLSYLLYSDILLKFSPTEITAPAMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYASKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29558 - protein, 466 aa, Artificial Sequence; identical to SEQ ID NO: 29122
  neuraminidase__InfluenzaB__AGX21088

SEQ ID NO: 29559 - protein, 466 aa, Artificial Sequence; identical to SEQ ID NO: 29122
  neuraminidase__InfluenzaB__AGX21099

SEQ ID NO: 29560 - protein, 466 aa, Artificial Sequence
  neuraminidase__InfluenzaB__AGX21110
MLPSTIQTLTLFLTSGGVLLSLYVSALLSYLLYSDILLKFSPTEITAPTMSLDCANASNVQAVNRFATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29561 - protein, 466 aa, Artificial Sequence
  neuraminidase__InfluenzaB__AGX21121
MLPSTIQTLTLFLTSGGVLLSLYVSALLSYLLYSDILLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRITKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29562 - protein, 466 aa, Artificial Sequence; identical to SEQ ID NO: 29119
  neuraminidase__InfluenzaB__AGX21132

SEQ ID NO: 29563 - protein, 466 aa, Artificial Sequence; identical to SEQ ID NO: 28895
  neuraminidase__InfluenzaB__AGX21143

SEQ ID NO: 29564 - protein, 466 aa, Artificial Sequence; identical to SEQ ID NO: 28956
  neuraminidase__InfluenzaB__AGX21154

SEQ ID NO: 29565 - protein, 466 aa, Artificial Sequence
  neuraminidase__InfluenzaB__AGX21165
MLPSTIQTLTLFLTSGGVLLSLYVSALLSYLLYSDILLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNMETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29566 - protein, 466 aa, Artificial Sequence; identical to SEQ ID NO: 28956
  neuraminidase__InfluenzaB__AGX21176

SEQ ID NO: 29567 - protein, 466 aa, Artificial Sequence
  neuraminidase__InfluenzaB__AGX21187
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECVCRDNSYTAKRPFVKLNVETDTAEVRLMCTDTYLDTPRPNDGSITGPCESDGDKGSGGIKGGFVHQRMESKIGRWYSRTMSKTERMGMGLYVKYDGDPWADSDALTFSGVMVSMKEPGWYSFGFEIKDKKCDVPCIGIEMVHDGGKETWHSAATAIYCLMGSGQLLWDTVTGVDMAL

SEQ ID NO: 29568 - protein, 466 aa, Artificial Sequence
  neuraminidase__InfluenzaB__AGX21198
MLPSTIQMLTLFLTSGGVLLSLYVSASLSYLLYSDILLKFSPTEITAPTMPLDCANASNVHAVNRSATKGVTFLLPEPEWTYPRLSCPGSTFQKALLISPHRFGETKGNSAPLIIREPFIACEPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERKGMGLYVKYDGDPWTDSDALAFRGVMVSMKEPGWYSFGFEIKDKKCDVPCIGIEMVHDGGKETWHSAATAIYCLMGSGQLLWDTVTGVDMAL

SEQ ID NO: 29569 - protein, 466 aa, Artificial Sequence; identical to SEQ ID NO: 28956
  neuraminidase__InfluenzaB__AGX21209

SEQ ID NO: 29570 - protein, 466 aa, Artificial Sequence; identical to SEQ ID NO: 29119
  neuraminidase__InfluenzaB__AGX21220

SEQ ID NO: 29571 - protein, 466 aa, Artificial Sequence
  neuraminidase__InfluenzaB__AGX21231
MLPSTIQTLTLFLTSGGVLLSLYVSALLSYLLYSDILLKFSPTEITAPTMSLDCANASNVQAVNRSATKGVTFLLPESEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29572 - protein, 466 aa, Artificial Sequence; identical to SEQ ID NO: 29122
  neuraminidase__InfluenzaB__AGX21242

SEQ ID NO: 29573 - protein, 466 aa, Artificial Sequence; identical to SEQ ID NO: 28956
  neuraminidase__InfluenzaB__AGX21253

SEQ ID NO: 29574 - protein, 466 aa, Artificial Sequence
  neuraminidase__InfluenzaB__AGX21264
MLPSTIQTLTLFLTSGGVLLSLYVSASLSYLLYSDILLKFSTTEITAPTMPLDCANASNVQAVNRSATKGVTLLLPEPEWTYPRLSCPGSTFQKALLISPHRFGENKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRMESKIGRWYSRTMSKTERMGMGLYVKYDGDPWADSDALAFSGVMVSMKEPSWYSFGFEIKDKKCDVPCIGIEMVHDGGKETWHSAATAIYCLMGSGQLLWDTVTGVDMAL

SEQ ID NO: 29575 - protein, 466 aa, Artificial Sequence; identical to SEQ ID NO: 28895
  neuraminidase__InfluenzaB__AGX21275

SEQ ID NO: 29576 - protein, 466 aa, Artificial Sequence; identical to SEQ ID NO: 28956
  neuraminidase__InfluenzaB__AGX21286

SEQ ID NO: 29577 - protein, 466 aa, Artificial Sequence
  neuraminidase__InfluenzaB__AGX21297
MLPSTIQTLTLFLTSGGVLLSLYVSASLSYLLYSDILLKFSPTEITAPTMPLDCANASNVQAVNRSATKGVTLLLPEPDWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEVRLMCTDTYLDTPRPNDGSITGPCESDGDKGSGGIKGGFVHQRMESKIGRWYSRTMSKTERMGMGLYVKYDGDPWADSDALTFSGVMVSMKEPGWYSFGFEIKDKKCDVPCIGIEMVHDGGKETWHSAATAIYCLMGSGQLLWDTVTGVDMAL

SEQ ID NO: 29578 - protein, 466 aa, Artificial Sequence
  neuraminidase__InfluenzaB__AGX21308
MLPSTIQMLTLFLTSGGVLLSLYVSASLSYLLYSDILLKFSPTEITAPTMPLDCANASNVHAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERKGMGLYVKYDGDPWTDSDALALRGVMVSMKEPGWYSFGFEIKDKKCDVPCIGIEMVHDGGKETWHSAATAIYCLMGSGQLLWDTVTGVDMAL

SEQ ID NO: 29579 - protein, 466 aa, Artificial Sequence; identical to SEQ ID NO: 28900
  neuraminidase__InfluenzaB__AGX21319

SEQ ID NO: 29580 - protein, 466 aa, Artificial Sequence; identical to SEQ ID NO: 28895
  neuraminidase__InfluenzaB__AGX21330

SEQ ID NO: 29581 - protein, 466 aa, Artificial Sequence; identical to SEQ ID NO: 28895
  neuraminidase__InfluenzaB__AGX21341

SEQ ID NO: 29582 - protein, 466 aa, Artificial Sequence; identical to SEQ ID NO: 29122
  neuraminidase__InfluenzaB__AGX21352

SEQ ID NO: 29583 - protein, 466 aa, Artificial Sequence
  neuraminidase__InfluenzaB__AGX21363
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISSHRFGETKGNSAPLIIREPFVACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29584 - protein, 466 aa, Artificial Sequence; identical to SEQ ID NO: 28895
  neuraminidase__InfluenzaB__AGX21374

SEQ ID NO: 29585 - protein, 466 aa, Artificial Sequence; identical to SEQ ID NO: 28956
  neuraminidase__InfluenzaB__AGX21385

SEQ ID NO: 29586 - protein, 466 aa, Artificial Sequence; identical to SEQ ID NO: 28956
  neuraminidase__InfluenzaB__AGX21396

SEQ ID NO: 29587 - protein, 466 aa, Artificial Sequence; identical to SEQ ID NO: 28895
  neuraminidase__InfluenzaB__AGX21407

SEQ ID NO: 29588 - protein, 466 aa, Artificial Sequence; identical to SEQ ID NO: 28895
  neuraminidase__InfluenzaB__AGX21418

SEQ ID NO: 29589 - protein, 466 aa, Artificial Sequence
  neuraminidase__InfluenzaB__AGX21429
MLPSTIQTLTLFLTSGGVLLSLYVSALLSYLLHSDILLKFSPTEITAPTMSLDCANASNVQAVNRSVTKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29590 - protein, 466 aa, Artificial Sequence; identical to SEQ ID NO: 28956
  neuraminidase__InfluenzaB__AGX21440

SEQ ID NO: 29591 - protein, 466 aa, Artificial Sequence; identical to SEQ ID NO: 28956
  neuraminidase__InfluenzaB__AGX21451

SEQ ID NO: 29592 - protein, 466 aa, Artificial Sequence; identical to SEQ ID NO: 29540
  neuraminidase__InfluenzaB__AGX21462

SEQ ID NO: 29593 - protein, 466 aa, Artificial Sequence
  neuraminidase__InfluenzaB__AGX21473
MLPSTIQTLTLFLTSGGVLLSLYVSALLSYLLYSDILLKFSPTEITAPTMSLDCANASNVQAVNRSATKGVTFLLPEPEWTYPRLSCPGSTFQRALLISPHRFGEAKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEILPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALVFSGVMVSMKEPGWYSFGFEIKDKKCDVPCIGIEMVHDGGKETWHSAATAIYCLMGSGQLLWDTVTGVDMAL

SEQ ID NO: 29594 - protein, 466 aa, Artificial Sequence; identical to SEQ ID NO: 28900
  neuraminidase__InfluenzaB__AGX21484

SEQ ID NO: 29595 - protein, 466 aa, Artificial Sequence; identical to SEQ ID NO: 28956
  neuraminidase__InfluenzaB__AGX21495

SEQ ID NO: 29596 - protein, 466 aa, Artificial Sequence; identical to SEQ ID NO: 28956
  neuraminidase__InfluenzaB__AGX21506

SEQ ID NO: 29597 - protein, 466 aa, Artificial Sequence
  neuraminidase__InfluenzaB__AGX21517
MLPSTIQTLTLFLTSGGVLLSLYVSALLSYLLYSNILLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29598 - protein, 466 aa, Artificial Sequence
  neuraminidase__InfluenzaB__AGX21528
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEVRLMCTDTYLDTPRPNDGSITGPCESDGDKGSGGIKGGFVHQRMESKIGRWYSRTMSKTERMGMGLYVKYDGDPWADSDALTFSGVMVSMKEPGWYSFGFEIKDKKCDVPCIGIEMVHDSGKETWHSAATAIYCLMGSGQLLWDTVTGVDMAL

SEQ ID NO: 29599 - protein, 466 aa, Artificial Sequence; identical to SEQ ID NO: 28956
  neuraminidase__InfluenzaB__AGX21539

SEQ ID NO: 29600 - protein, 466 aa, Artificial Sequence
  neuraminidase__InfluenzaB__AGX21550
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPAGRVKHTEECTCGFASNKTIECACRDNSYTAKRPFVKLNVETDTAEVRLMCTDTYLDTPRPNDGSITGPCESDGDKGSGGIKGGFVHQRMESKIGRWYSRTMSKTERMGMGLYVKYDGDPWADSDALTFSGVMVSMKEPGWYSFGFEIKDKKCDVPCIGIEMVHDGGKETWHSAATAIYCLMGSGQLLWDTVTGVDMAL

SEQ ID NO: 29601 - protein, 466 aa, Artificial Sequence
  neuraminidase__InfluenzaB__AGX21561
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKVREGRIIKEIFPTGRVKHTEECTCGFASNKTIECACRDNSYTAKRPFVKLNVETDTAEVRLMCTDTYLDTPRPNDGSITGPCESDGDKGSGGIKGGFVHQRMESKIGRWYSRTMSKTERMGMGLYVKYDGDPWADSDALTFSGVMVSMKEPGWYSFGFEIKDKKCDVPCIGIEMVHDGGKETWHSAATAIYCLMGSGQLLWDTVTGVDMAL

SEQ ID NO: 29602 - protein, 466 aa, Artificial Sequence; identical to SEQ ID NO: 28900
  neuraminidase__InfluenzaB__AGX21572

SEQ ID NO: 29603 - protein, 466 aa, Artificial Sequence
  neuraminidase__InfluenzaB__AGX21583
MLPSTIQTLTLFLTSGGVLLSLYVSALLSYLLYSDILLKFSPTEITAPTMSLDCANASNVQAVNRSATKGVTFLLPEPEWTYPRLSCPGSTFQRALLISPHRFGEAKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEILPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMELYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29604 - protein, 466 aa, Artificial Sequence; identical to SEQ ID NO: 28900
  neuraminidase__InfluenzaB__AGX21594

SEQ ID NO: 29605 - protein, 466 aa, Artificial Sequence; identical to SEQ ID NO: 29122
  neuraminidase__InfluenzaB__AGX21605

SEQ ID NO: 29606 - protein, 466 aa, Artificial Sequence
  neuraminidase__InfluenzaB__AGX21615
MLPSTIQTLTLFLTSGGVLLSLYVSASLSYLLYSDILLKFSTTEITAPTMPLDCANASNVQAVNRSATKGVTLLLPEPEWTYPRLSCPGSTFQKALLISPHRFGENKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29607 - protein, 466 aa, Artificial Sequence; identical to SEQ ID NO: 28956
  neuraminidase__InfluenzaB__AGX21626

SEQ ID NO: 29608 - protein, 466 aa, Artificial Sequence; identical to SEQ ID NO: 28956
  neuraminidase__InfluenzaB__AGX21637

SEQ ID NO: 29609 - protein, 466 aa, Artificial Sequence; identical to SEQ ID NO: 28956
  neuraminidase__InfluenzaB__AGX21648

SEQ ID NO: 29610 - protein, 466 aa, Artificial Sequence
  neuraminidase__InfluenzaB__AGX21659
MLPSTIQTLTLFLTSGGVLLSLYVSALLSYLLYSDILLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLVSVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYGGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29611 - protein, 466 aa, Artificial Sequence
  neuraminidase__InfluenzaB__AGX21670
MLPSTIQTLTLFLTSGGVLLSLYVSALLSYLLYSDILLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGTEMVHDGGKETWHSAATAIYCLMGSGQLLWDTVTGVDMAL

SEQ ID NO: 29612 - protein, 466 aa, Artificial Sequence
  neuraminidase__InfluenzaB__AGX21681
MLPSTIQMLTLFLTSGGVLLSLYVSASLSYLLYSDILLKFSPTEITAPTMPLDCANASNVHAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGNGGIKGGFVHQRMASKIGRWYSRTMSKTERKGMGLYVKYDGDPWTDSDALAFRGVMVSMKEPGWYSFGFEIKDKKCDVPCIGIEMVHDGGKETWHSAATAIYCLMGSGQLLWDTVTGVDMAL

SEQ ID NO: 29613 - protein, 466 aa, Artificial Sequence; identical to SEQ ID NO: 28895
  neuraminidase__InfluenzaB__AGX21692

SEQ ID NO: 29614 - protein, 466 aa, Artificial Sequence; identical to SEQ ID NO: 29122
  neuraminidase__InfluenzaB__AGX21703

SEQ ID NO: 29615 - protein, 466 aa, Artificial Sequence
  neuraminidase__InfluenzaB__AGX21714
MLPSTIQTLTLFLTSGGVLLSLYVSASLSYLLYSDILLKFSPTEITAPAMPLDCANASNVQAVNRSATKGLTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29616 - protein, 466 aa, Artificial Sequence
  neuraminidase__InfluenzaB__AGX21725
MLPSTIQMLTLFLTSGGVLLSLYVSASLSYLLYSDILLKFSPTEITAPTMPLDCANASNVHAVNRSATKGVTFLLPEPEWTYPRLSCPGSTFQRALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERKGMGLYVKYDGDPWTDSDALAFRGVMVSMKEPGWYSFGFEIKDKKCDVPCIGIEMVHDGGKETWHSAATAIYCLMGSGQLLWDTVTGVDMAL

SEQ ID NO: 29617 - protein, 466 aa, Artificial Sequence
  neuraminidase__InfluenzaB__AGX21747
MLPSTIQTLTLFLTSGGVLLSLYVSASLSYLLYSDILLKVSQTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29618 - protein, 466 aa, Artificial Sequence
  neuraminidase__InfluenzaB__AGX21758
MLPSTIQTLTLFLTSGGVLLSLYVSASLSYLLYSDILLKFTPTEITVPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGNKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 29619 - protein, 466 aa, Artificial Sequence
  neuraminidase__InfluenzaB__AGX21769
MLPSTIQTLTLFLTSGGVLLSLYVSASLSYLLYSDILLKFSQTEITAPTMPLDCANASNVQAANRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGSASGISECRFLKIREGRIIKEIFPTGRVKHTEECTCGFASNKTIECACRDNSYTAKRPFVKLNVETDTAEIRLMCTKTYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29620 - protein, 466 aa, Artificial Sequence
  neuraminidase__InfluenzaB__AGX21780
MLPSTIQTLTLFLTSGGVLLSLYVSASLSYLLYSDILLKFSQTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGSASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMESKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMTL

SEQ ID NO: 29621 - protein, 466 aa, Artificial Sequence
  neuraminidase__InfluenzaB__AGX21791
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYSGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNNYTAKRPFVKLNVETDTAEIRLMCTETYLDTPRPDDGSITGPCESNGDKGSGGIKGGFVHQRMASKIGRWYSRTMSKNKRMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29622 - protein, 466 aa, Artificial Sequence
  neuraminidase__InfluenzaB__AGX21802
MLPSTIQTLTLFLTSGGVLLSLYVSASLSYLLYSDILLKFSQTEITAPTMPLDCANASNVQAANRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGSASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29623 - protein, 466 aa, Artificial Sequence
  neuraminidase__InfluenzaB__AGX21813
MLPSTIQTLTLFLTSGGVLLSLYVSASLSYLLYSDILLKFSQTEITAPKMPLDCANASNVQAANRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGSASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29624 - protein, 466 aa, Artificial Sequence
  neuraminidase__InfluenzaB__AGX21824
MLPSTIQTLTLFLTSGGVLLSLYVSASLSYLLYSDILLKFSQTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKNTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29625 - protein, 466 aa, Artificial Sequence; identical to SEQ ID NO: 28743
  neuraminidase__InfluenzaB__AGX21835

SEQ ID NO: 29626 - protein, 466 aa, Artificial Sequence; identical to SEQ ID NO: 29131
  neuraminidase__InfluenzaB__AGX21846

SEQ ID NO: 29627 - protein, 466 aa, Artificial Sequence; identical to SEQ ID NO: 29131
  neuraminidase__InfluenzaB__AGX21857

SEQ ID NO: 29628 - protein, 466 aa, Artificial Sequence; identical to SEQ ID NO: 28743
  neuraminidase__InfluenzaB__AGX21868

SEQ ID NO: 29629 - protein, 466 aa, Artificial Sequence; identical to SEQ ID NO: 29129
  neuraminidase__InfluenzaB__AGX21879

SEQ ID NO: 29630 - protein, 466 aa, Artificial Sequence
  neuraminidase__InfluenzaB__AGX21890
MLPSTIQTLTLFLTSGGVLLSLYVSASLSYLLYSDILLKFSQTEIIAPIMPLDCANASNVQAVNHSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29631 - protein, 466 aa, Artificial Sequence; identical to SEQ ID NO: 28743
  neuraminidase__InfluenzaB__AGX21901

SEQ ID NO: 29632 - protein, 466 aa, Artificial Sequence; identical to SEQ ID NO: 28743
  neuraminidase__InfluenzaB__AGX21912

SEQ ID NO: 29633 - protein, 466 aa, Artificial Sequence
  neuraminidase__InfluenzaB__AGX21923
MLPSTIQTLTLFLTSGGVLLSLYVSASLSYLLYSDILLKFSQTEITAPIMPLDCTNASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29634 - protein, 466 aa, Artificial Sequence; identical to SEQ ID NO: 29630
  neuraminidase__InfluenzaB__AGX21934

SEQ ID NO: 29635 - protein, 466 aa, Artificial Sequence; identical to SEQ ID NO: 29131
  neuraminidase__InfluenzaB__AGX21945

SEQ ID NO: 29636 - protein, 466 aa, Artificial Sequence
  neuraminidase__InfluenzaB__AGX21956
MLPSTIQTLTLFLTSGGVLLSLYVSASLSYLLYSDILLKFSQTEITAPIMPLDCANTSNIQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29637 - protein, 466 aa, Artificial Sequence; identical to SEQ ID NO: 29131
  neuraminidase__InfluenzaB__AGX21967

SEQ ID NO: 29638 - protein, 466 aa, Artificial Sequence; identical to SEQ ID NO: 28743
  neuraminidase__InfluenzaB__AGX21978

SEQ ID NO: 29639 - protein, 466 aa, Artificial Sequence; identical to SEQ ID NO: 29131
  neuraminidase__InfluenzaB__AGX21989

SEQ ID NO: 29640 - protein, 466 aa, Artificial Sequence; identical to SEQ ID NO: 29129
  neuraminidase__InfluenzaB__AGX22000

SEQ ID NO: 29641 - protein, 466 aa, Artificial Sequence
  neuraminidase__InfluenzaB__AGX22011
MLPSTIQTLTLFLTSGGVLLSLYVSASLSYLLYSDILLKFSQTEITAPIMPLDCANASNVQAVNRSATKGVTLLLPEPEWTYPRLSCPGSTFQKALLISPHRFGETKGNSAPLIIREPFIACGPKECKHFALTHYAAKPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNNYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29642 - protein, 466 aa, Artificial Sequence; identical to SEQ ID NO: 28743
  neuraminidase__InfluenzaB__AGX22033

SEQ ID NO: 29643 - protein, 466 aa, Artificial Sequence; identical to SEQ ID NO: 28743
  neuraminidase__InfluenzaB__AGX22044

SEQ ID NO: 29644 - protein, 466 aa, Artificial Sequence; identical to SEQ ID NO: 29129
  neuraminidase__InfluenzaB__AGX22055

SEQ ID NO: 29645 - protein, 466 aa, Artificial Sequence; identical to SEQ ID NO: 28743
  neuraminidase__InfluenzaB__AGX22066

SEQ ID NO: 29646 - protein, 466 aa, Artificial Sequence; identical to SEQ ID NO: 29630
  neuraminidase__InfluenzaB__AGX22077

SEQ ID NO: 29647 - protein, 466 aa, Artificial Sequence; identical to SEQ ID NO: 28745
  neuraminidase__InfluenzaB__AGX22088

SEQ ID NO: 29648 - protein, 466 aa, Artificial Sequence; identical to SEQ ID NO: 29131
  neuraminidase__InfluenzaB__AGX22099

SEQ ID NO: 29649 - protein, 466 aa, Artificial Sequence; identical to SEQ ID NO: 29129
  neuraminidase__InfluenzaB__AGX22110

SEQ ID NO: 29650 - protein, 466 aa, Artificial Sequence; identical to SEQ ID NO: 29131
  neuraminidase__InfluenzaB__AGX22132

SEQ ID NO: 29651 - protein, 466 aa, Artificial Sequence
  neuraminidase__InfluenzaB__AGX22143
MLPSTIQTLTLFLTSGGVLLSLYVSASLSYLLYSDILLKFSQTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTISKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29652 - protein, 466 aa, Artificial Sequence; identical to SEQ ID NO: 29651
  neuraminidase__InfluenzaB__AGX22154

SEQ ID NO: 29653 - protein, 466 aa, Artificial Sequence; identical to SEQ ID NO: 29651
  neuraminidase__InfluenzaB__AGX22165

SEQ ID NO: 29654 - protein, 466 aa, Artificial Sequence; identical to SEQ ID NO: 29630
  neuraminidase__InfluenzaB__AGX22176

SEQ ID NO: 29655 - protein, 466 aa, Artificial Sequence; identical to SEQ ID NO: 29651
  neuraminidase__InfluenzaB__AGX22187

SEQ ID NO: 29656 - protein, 466 aa, Artificial Sequence; identical to SEQ ID NO: 29651
  neuraminidase__InfluenzaB__AGX22198

SEQ ID NO: 29657 - protein, 466 aa, Artificial Sequence; identical to SEQ ID NO: 29651
  neuraminidase__InfluenzaB__AGX22209

SEQ ID NO: 29658 - protein, 466 aa, Artificial Sequence; identical to SEQ ID NO: 29129
  neuraminidase__InfluenzaB__AGX22220

SEQ ID NO: 29659 - protein, 466 aa, Artificial Sequence; identical to SEQ ID NO: 29131
  neuraminidase__InfluenzaB__AGX22231

SEQ ID NO: 29660 - protein, 466 aa, Artificial Sequence; identical to SEQ ID NO: 29630
  neuraminidase__InfluenzaB__AGX22242

SEQ ID NO: 29661 - protein, 466 aa, Artificial Sequence; identical to SEQ ID NO: 29129
  neuraminidase__InfluenzaB__AGX22253

SEQ ID NO: 29662 - protein, 466 aa, Artificial Sequence; identical to SEQ ID NO: 28743
  neuraminidase__InfluenzaB__AGX22264

SEQ ID NO: 29663 - protein, 466 aa, Artificial Sequence; identical to SEQ ID NO: 29129
  neuraminidase__InfluenzaB__AGX22275

SEQ ID NO: 29664 - protein, 466 aa, Artificial Sequence; identical to SEQ ID NO: 28743
  neuraminidase__InfluenzaB__AGX22286

SEQ ID NO: 29665 - protein, 466 aa, Artificial Sequence
  neuraminidase__InfluenzaB__AGX22297
MLPSTIQTLTLFLTLGGVLLSLYVSASLSYLLYSDILLKFSQTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29666 - protein, 466 aa, Artificial Sequence; identical to SEQ ID NO: 28743
  neuraminidase__InfluenzaB__AGX22308

SEQ ID NO: 29667 - protein, 466 aa, Artificial Sequence
  neuraminidase__InfluenzaB__AGX22330
MLPSTIQTLTLFLTSGGVLLSLYVSASLSYLLYSDILLKFSQTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMTAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMATKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29668 - protein, 466 aa, Artificial Sequence; identical to SEQ ID NO: 29131
  neuraminidase__InfluenzaB__AGX22341

SEQ ID NO: 29669 - protein, 466 aa, Artificial Sequence; identical to SEQ ID NO: 29131
  neuraminidase__InfluenzaB__AGX22352

SEQ ID NO: 29670 - protein, 466 aa, Artificial Sequence; identical to SEQ ID NO: 29131
  neuraminidase__InfluenzaB__AGX22363

SEQ ID NO: 29671 - protein, 466 aa, Artificial Sequence; identical to SEQ ID NO: 29129
  neuraminidase__InfluenzaB__AGX22374

SEQ ID NO: 29672 - protein, 466 aa, Artificial Sequence; identical to SEQ ID NO: 28743
  neuraminidase__InfluenzaB__AGX22385

SEQ ID NO: 29673 - protein, 466 aa, Artificial Sequence; identical to SEQ ID NO: 28743
  neuraminidase__InfluenzaB__AGX22396

SEQ ID NO: 29674 - protein, 466 aa, Artificial Sequence; identical to SEQ ID NO: 29630
  neuraminidase__InfluenzaB__AGX22407

SEQ ID NO: 29675 - protein, 466 aa, Artificial Sequence
  neuraminidase__InfluenzaB__AGX22418
MLPSTIQTLTLFLTSGGVLLSLYVSASLSYLLYSDILLKFSQTEIIAPIMPLDCANASNVQAVNHSATKGVTLLLPEPEWTYPRLSCPGSTFQKALLISPHRFGETKGNSAPLIIREPFIACGPKECKHFALTHYAAQPGRYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29676 - protein, 466 aa, Artificial Sequence; identical to SEQ ID NO: 29129
  neuraminidase__InfluenzaB__AGX22429

SEQ ID NO: 29677 - protein, 466 aa, Artificial Sequence; identical to SEQ ID NO: 29129
  neuraminidase__InfluenzaB__AGX22440

SEQ ID NO: 29678 - protein, 466 aa, Artificial Sequence; identical to SEQ ID NO: 29129
  neuraminidase__InfluenzaB__AGX22449

SEQ ID NO: 29679 - protein, 466 aa, Artificial Sequence
  neuraminidase__InfluenzaB__AGX22460
MLPSTIQTLTLFLTSGGVLLSLYVSASLSYLLYSDILLKFSQTEITAPTMPLDCANASNVQAVNRSATKGVTLLLPELEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYVGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLDVETDTAEIRLMCTETYLDTPRPNDGSITGPCEANGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29680 - protein, 466 aa, Artificial Sequence; identical to SEQ ID NO: 28743
  neuraminidase__InfluenzaB__AGX22471

SEQ ID NO: 29681 - protein, 466 aa, Artificial Sequence; identical to SEQ ID NO: 28743
  neuraminidase__InfluenzaB__AGX22482

SEQ ID NO: 29682 - protein, 466 aa, Artificial Sequence; identical to SEQ ID NO: 28743
  neuraminidase__InfluenzaB__AGX22493

SEQ ID NO: 29683 - protein, 466 aa, Artificial Sequence
  neuraminidase__InfluenzaB__AGX22504
MLPSTIQTLTLFLTSGGVLLSLYVSASLSYLLYSDILLKFSTTEITAPTIPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGNKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 29684 - protein, 466 aa, Artificial Sequence; identical to SEQ ID NO: 29129
  neuraminidase__InfluenzaB__AGX22515

SEQ ID NO: 29685 - protein, 466 aa, Artificial Sequence
  neuraminidase__InfluenzaB__AGX22526
MLPSTIQTLTLFLTSGGVLLSLYVSASLSYLLYSDILQKFSQTEITAPIMPLDCANASNVQAVNRSATKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29686 - protein, 466 aa, Artificial Sequence; identical to SEQ ID NO: 28788
  neuraminidase__InfluenzaB__AGX22548

SEQ ID NO: 29687 - protein, 466 aa, Artificial Sequence; identical to SEQ ID NO: 28627
  neuraminidase__InfluenzaB__AGX22559

SEQ ID NO: 29688 - protein, 466 aa, Artificial Sequence; identical to SEQ ID NO: 28788
  neuraminidase__InfluenzaB__AGX22570

SEQ ID NO: 29689 - protein, 466 aa, Artificial Sequence
  neuraminidase__InfluenzaB__AGX22581
MLPSTIQTLTLFLTSGGVLLSLYVSASLSYLLYSDILLKFSQTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDNNALLKIKYGEAYTDTYHSYAKNILRTQESACNCIGGDCYLMITDGPASGISECRFLKIREGRIIKEIFPTGRVKHTEECTCGFASNKTIECACRDNNYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29690 - protein, 466 aa, Artificial Sequence; identical to SEQ ID NO: 28788
  neuraminidase__InfluenzaB__AGX22592

SEQ ID NO: 29691 - protein, 466 aa, Artificial Sequence; identical to SEQ ID NO: 28788
  neuraminidase__InfluenzaB__AGX22603

SEQ ID NO: 29692 - protein, 466 aa, Artificial Sequence; identical to SEQ ID NO: 29028
  neuraminidase__InfluenzaB__AGX22614

SEQ ID NO: 29693 - protein, 466 aa, Artificial Sequence; identical to SEQ ID NO: 28788
  neuraminidase__InfluenzaB__AGX22625

SEQ ID NO: 29694 - protein, 466 aa, Artificial Sequence
  neuraminidase__InfluenzaB__AGX22636
MLPSTIQTLTLFLTSGGVLLSLYVSASLSYLLYSDILLKFSQTEITAPIMPLDCANASNVQAVNRSAAKGVALLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29695 - protein, 466 aa, Artificial Sequence; identical to SEQ ID NO: 28788
  neuraminidase__InfluenzaB__AGX22647

SEQ ID NO: 29696 - protein, 466 aa, Artificial Sequence; identical to SEQ ID NO: 28627
  neuraminidase__InfluenzaB__AGX22658

SEQ ID NO: 29697 - protein, 466 aa, Artificial Sequence; identical to SEQ ID NO: 28788
  neuraminidase__InfluenzaB__AGX22669

SEQ ID NO: 29698 - protein, 466 aa, Artificial Sequence; identical to SEQ ID NO: 28788
  neuraminidase__InfluenzaB__AGX22680

SEQ ID NO: 29699 - protein, 466 aa, Artificial Sequence; identical to SEQ ID NO: 28788
  neuraminidase__InfluenzaB__AGX22691

SEQ ID NO: 29700 - protein, 466 aa, Artificial Sequence; identical to SEQ ID NO: 28788
  neuraminidase__InfluenzaB__AGX22702

SEQ ID NO: 29701 - protein, 466 aa, Artificial Sequence; identical to SEQ ID NO: 28788
  neuraminidase__InfluenzaB__AGX22713

SEQ ID NO: 29702 - protein, 466 aa, Artificial Sequence
  neuraminidase__InfluenzaB__AGX22724
MLPSTIQTLTLFLTSGGVLLSLYVSALLSYLLYSDILLKFSQTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29703 - protein, 466 aa, Artificial Sequence; identical to SEQ ID NO: 28788
  neuraminidase__InfluenzaB__AGX22735

SEQ ID NO: 29704 - protein, 466 aa, Artificial Sequence
  neuraminidase__InfluenzaB__AGX22746
MLPSTIQTLTLFLTSGGVLLSLYVSASLSYLLYSDILLKFSQTEITAPIMPLDCANASNVQAVNRSATKGVTLLLPEPEWTYPRLSCPGSTFQKALLISPHRFGETKGNSAPLIIREPFIACGPTECKHFALTHYAAQPGGYYNRTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29705 - protein, 466 aa, Artificial Sequence; identical to SEQ ID NO: 28788
  neuraminidase__InfluenzaB__AGX22757

SEQ ID NO: 29706 - protein, 466 aa, Artificial Sequence; identical to SEQ ID NO: 28788
  neuraminidase__InfluenzaB__AGX22768

SEQ ID NO: 29707 - protein, 466 aa, Artificial Sequence; identical to SEQ ID NO: 29129
  neuraminidase__InfluenzaB__AGX22779

SEQ ID NO: 29708 - protein, 466 aa, Artificial Sequence; identical to SEQ ID NO: 28788
  neuraminidase__InfluenzaB__AGX22790

SEQ ID NO: 29709 - protein, 466 aa, Artificial Sequence
  neuraminidase__InfluenzaB__AGX22801
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTRGDRNKLRHLISVKLGKIPTVENSIFHMAAWSGSACHDGKEWTYIGVDGPDSNALLKIKYGEAYTDTYHSYAKNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29710 - protein, 466 aa, Artificial Sequence; identical to SEQ ID NO: 28788
  neuraminidase__InfluenzaB__AGX22812

SEQ ID NO: 29711 - protein, 466 aa, Artificial Sequence; identical to SEQ ID NO: 28788
  neuraminidase__InfluenzaB__AGX22823

SEQ ID NO: 29712 - protein, 466 aa, Artificial Sequence; identical to SEQ ID NO: 28788
  neuraminidase__InfluenzaB__AGX22834

SEQ ID NO: 29713 - protein, 466 aa, Artificial Sequence; identical to SEQ ID NO: 28788
  neuraminidase__InfluenzaB__AGX22845

SEQ ID NO: 29714 - protein, 466 aa, Artificial Sequence; identical to SEQ ID NO: 28788
  neuraminidase__InfluenzaB__AGX22856

SEQ ID NO: 29715 - protein, 466 aa, Artificial Sequence; identical to SEQ ID NO: 28788
  neuraminidase__InfluenzaB__AGX22867

SEQ ID NO: 29716 - protein, 466 aa, Artificial Sequence; identical to SEQ ID NO: 28788
  neuraminidase__InfluenzaB__AGX22878

SEQ ID NO: 29717 - protein, 466 aa, Artificial Sequence
  neuraminidase__InfluenzaB__AGX22889
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSHTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29718 - protein, 466 aa, Artificial Sequence; identical to SEQ ID NO: 28627
  neuraminidase__InfluenzaB__AGX22900

SEQ ID NO: 29719 - protein, 466 aa, Artificial Sequence
  neuraminidase__InfluenzaB__AGX22911
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGTSECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29720 - protein, 466 aa, Artificial Sequence
  neuraminidase__InfluenzaB__AGX22922
MLPSTIQTLTLFLTSGGVLLSLYVSASLSYLLYSDILLKFSQTEITAPIMPLDCANASNVQAVNRSATKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDNEALALSGVMVSMEEPGWYSFGFEIKDKKCDVPCIGIEMVHDGGKTTWHSAATAIYCLMGSGQLLWDTVTGVDMAL

SEQ ID NO: 29721 - protein, 466 aa, Artificial Sequence; identical to SEQ ID NO: 28788
  neuraminidase__InfluenzaB__AGX22933

SEQ ID NO: 29722 - protein, 466 aa, Artificial Sequence; identical to SEQ ID NO: 28788
  neuraminidase__InfluenzaB__AGX22944

SEQ ID NO: 29723 - protein, 466 aa, Artificial Sequence; identical to SEQ ID NO: 28788
  neuraminidase__InfluenzaB__AGX22955

SEQ ID NO: 29724 - protein, 466 aa, Artificial Sequence; identical to SEQ ID NO: 28788
  neuraminidase__InfluenzaB__AGX22966

SEQ ID NO: 29725 - protein, 466 aa, Artificial Sequence; identical to SEQ ID NO: 28627
  neuraminidase__InfluenzaB__AGX22977

SEQ ID NO: 29726 - protein, 466 aa, Artificial Sequence; identical to SEQ ID NO: 29043
  neuraminidase__InfluenzaB__AGX22988

SEQ ID NO: 29727 - protein, 466 aa, Artificial Sequence
  neuraminidase__InfluenzaB__AGX22999
MLPSTIQTLTLFLTSGGVLLSLYVSASLSYLLYSDILLKFSQTEITAPIMPLDCANASNVQAVNRSAAKGVTLLLPEPEWAYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29728 - protein, 466 aa, Artificial Sequence; identical to SEQ ID NO: 29727
  neuraminidase__InfluenzaB__AGX23010

SEQ ID NO: 29729 - protein, 466 aa, Artificial Sequence; identical to SEQ ID NO: 28627
  neuraminidase__InfluenzaB__AGX23021

SEQ ID NO: 29730 - protein, 466 aa, Artificial Sequence; identical to SEQ ID NO: 28788
  neuraminidase__InfluenzaB__AGX23032

SEQ ID NO: 29731 - protein, 466 aa, Artificial Sequence
  neuraminidase__InfluenzaB__AGX23043
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPALGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29732 - protein, 466 aa, Artificial Sequence; identical to SEQ ID NO: 28627
  neuraminidase__InfluenzaB__AGX23054

SEQ ID NO: 29733 - protein, 466 aa, Artificial Sequence; identical to SEQ ID NO: 28627
  neuraminidase__InfluenzaB__AGX23065

SEQ ID NO: 29734 - protein, 466 aa, Artificial Sequence; identical to SEQ ID NO: 28627
  neuraminidase__InfluenzaB__AGX23076

SEQ ID NO: 29735 - protein, 466 aa, Artificial Sequence; identical to SEQ ID NO: 28788
  neuraminidase__InfluenzaB__AGX23087

SEQ ID NO: 29736 - protein, 466 aa, Artificial Sequence; identical to SEQ ID NO: 28627
  neuraminidase__InfluenzaB__AGX23098

SEQ ID NO: 29737 - protein, 466 aa, Artificial Sequence
  neuraminidase__InfluenzaB__AGX23109
MLPSTIQTLTLFLTSGGVLLSLYVSASLSYLLYSDILLKFSQTEITAPIMPLDCANASNVQAVNRSATKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIRGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29738 - protein, 466 aa, Artificial Sequence; identical to SEQ ID NO: 28788
  neuraminidase__InfluenzaB__AGX23120

SEQ ID NO: 29739 - protein, 466 aa, Artificial Sequence
  neuraminidase__InfluenzaB__AGX23131
MLPSTIQTLTLFLTSGGVLLSLYVSASLSYLLYSDILLKFSQTEIIAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29740 - protein, 466 aa, Artificial Sequence; identical to SEQ ID NO: 28788
  neuraminidase__InfluenzaB__AGX23142

SEQ ID NO: 29741 - protein, 466 aa, Artificial Sequence; identical to SEQ ID NO: 28627
  neuraminidase__InfluenzaB__AGX23153

SEQ ID NO: 29742 - protein, 466 aa, Artificial Sequence; identical to SEQ ID NO: 28627
  neuraminidase__InfluenzaB__AGX23164

SEQ ID NO: 29743 - protein, 466 aa, Artificial Sequence; identical to SEQ ID NO: 28627
  neuraminidase__InfluenzaB__AGX23175

SEQ ID NO: 29744 - protein, 466 aa, Artificial Sequence
  neuraminidase__InfluenzaB__AGX23186
MLPSTTQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29745 - protein, 466 aa, Artificial Sequence; identical to SEQ ID NO: 28788
  neuraminidase__InfluenzaB__AGX23197

SEQ ID NO: 29746 - protein, 466 aa, Artificial Sequence; identical to SEQ ID NO: 28788
  neuraminidase__InfluenzaB__AGX23208

SEQ ID NO: 29747 - protein, 466 aa, Artificial Sequence; identical to SEQ ID NO: 28788
  neuraminidase__InfluenzaB__AGX23219

SEQ ID NO: 29748 - protein, 466 aa, Artificial Sequence
  neuraminidase__InfluenzaB__AGX23230
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGEYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPSSGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29749 - protein, 466 aa, Artificial Sequence; identical to SEQ ID NO: 28627
  neuraminidase__InfluenzaB__AGX23241

SEQ ID NO: 29750 - protein, 466 aa, Artificial Sequence; identical to SEQ ID NO: 28788
  neuraminidase__InfluenzaB__AGX23252

SEQ ID NO: 29751 - protein, 466 aa, Artificial Sequence; identical to SEQ ID NO: 28788
  neuraminidase__InfluenzaB__AGX23263

SEQ ID NO: 29752 - protein, 466 aa, Artificial Sequence; identical to SEQ ID NO: 28788
  neuraminidase__InfluenzaB__AGX23274

SEQ ID NO: 29753 - protein, 466 aa, Artificial Sequence; identical to SEQ ID NO: 28627
  neuraminidase__InfluenzaB__AGX23285

SEQ ID NO: 29754 - protein, 466 aa, Artificial Sequence; identical to SEQ ID NO: 28788
  neuraminidase__InfluenzaB__AGX23296

SEQ ID NO: 29755 - protein, 466 aa, Artificial Sequence
  neuraminidase__InfluenzaB__AGX23307
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYVGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29756 - protein, 466 aa, Artificial Sequence; identical to SEQ ID NO: 29755
  neuraminidase__InfluenzaB__AGX23318

SEQ ID NO: 29757 - protein, 466 aa, Artificial Sequence; identical to SEQ ID NO: 29755
  neuraminidase__InfluenzaB__AGX23329

SEQ ID NO: 29758 - protein, 466 aa, Artificial Sequence; identical to SEQ ID NO: 29755
  neuraminidase__InfluenzaB__AGX23340

SEQ ID NO: 29759 - protein, 466 aa, Artificial Sequence; identical to SEQ ID NO: 29755
  neuraminidase__InfluenzaB__AGX23351

SEQ ID NO: 29760 - protein, 466 aa, Artificial Sequence; identical to SEQ ID NO: 29755
  neuraminidase__InfluenzaB__AGX23362

SEQ ID NO: 29761 - protein, 466 aa, Artificial Sequence; identical to SEQ ID NO: 29755
  neuraminidase__InfluenzaB__AGX23373

SEQ ID NO: 29762 - protein, 466 aa, Artificial Sequence; identical to SEQ ID NO: 29755
  neuraminidase__InfluenzaB__AGX23384

SEQ ID NO: 29763 - protein, 466 aa, Artificial Sequence
  neuraminidase__InfluenzaB__AGX23395
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYVGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWNTVTGVDMAL

SEQ ID NO: 29764 - protein, 466 aa, Artificial Sequence
  neuraminidase__InfluenzaB__AGX23417
MLPSTIQTLTLFLTSGGVLLSLYVSASLSYLLYSDILLKFSQTEITAPIMPLDCANASNVQAVNRSAAKGVTFLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29765 - protein, 466 aa, Artificial Sequence; identical to SEQ ID NO: 29764
  neuraminidase__InfluenzaB__AGX23428

SEQ ID NO: 29766 - protein, 466 aa, Artificial Sequence; identical to SEQ ID NO: 29147
  neuraminidase__InfluenzaB__AGX23450

SEQ ID NO: 29767 - protein, 466 aa, Artificial Sequence
  neuraminidase__InfluenzaB__AGX23461
MLPSTIQTLTLFLTSGGVLLSLYVSASLSYLLYSDILLKFSRTEITAPIMPLDCANASNIQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSIEEPGWYSFGFEIKDKKCDVPCIGIEMVHDGGKTTWHSAATAIYCLMGSGQLLWDTVTGVDMAL

SEQ ID NO: 29768 - protein, 466 aa, Artificial Sequence; identical to SEQ ID NO: 29147
  neuraminidase__InfluenzaB__AGX23472

SEQ ID NO: 29769 - protein, 466 aa, Artificial Sequence; identical to SEQ ID NO: 28788
  neuraminidase__InfluenzaB__AGX23483

SEQ ID NO: 29770 - protein, 466 aa, Artificial Sequence
  neuraminidase__InfluenzaB__AGX23494
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYVGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCGSDGDKGSGGIKGGFVHQRMASKIGRWYSRTMSKTKRMGMGLYVKYDGDPWTDSEALALSGVMVSMDEPGWYSFGFEIKDKKCDVPCIGIEMVHDGGKTTWHSAATAIYCLMGSGQLLWDTVTGVDMAL

SEQ ID NO: 29771 - protein, 466 aa, Artificial Sequence
  neuraminidase__InfluenzaB__AGX23505
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDNNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29772 - protein, 466 aa, Artificial Sequence
  neuraminidase__InfluenzaB__AGX23516
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGVSECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKAKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29773 - protein, 466 aa, Artificial Sequence; identical to SEQ ID NO: 28788
  neuraminidase__InfluenzaB__AGX23527

SEQ ID NO: 29774 - protein, 466 aa, Artificial Sequence
  neuraminidase__InfluenzaB__AGX23538
MLPSTIQTLTLFLTSGGVLLSLYVSASLSYLLYSDILLKFSQTEITAPIMPLDCANASNVQAVNRSAAKGVTLLLPKPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGVSECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSTTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29775 - protein, 466 aa, Artificial Sequence
  neuraminidase__InfluenzaB__AGX23549
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGVSECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSTTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29776 - protein, 466 aa, Artificial Sequence; identical to SEQ ID NO: 28788
  neuraminidase__InfluenzaB__AGX23560

SEQ ID NO: 29777 - protein, 466 aa, Artificial Sequence; identical to SEQ ID NO: 29770
  neuraminidase__InfluenzaB__AGX23571

SEQ ID NO: 29778 - protein, 466 aa, Artificial Sequence; identical to SEQ ID NO: 29770
  neuraminidase__InfluenzaB__AGX23582

SEQ ID NO: 29779 - protein, 466 aa, Artificial Sequence
  neuraminidase__InfluenzaB__AGX23593
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALTLSGVMVSMEEPGWYSFGFEIKDKKCDVPCIGIEMVHDGGKTTWHSAATAIYCLMGSGQLLWDTVTGVDMAL

SEQ ID NO: 29780 - protein, 466 aa, Artificial Sequence; identical to SEQ ID NO: 28788
  neuraminidase__InfluenzaB__AGX23604

SEQ ID NO: 29781 - protein, 466 aa, Artificial Sequence
  neuraminidase__InfluenzaB__AGX23615
MLPSTIQTLTLFLTSGGVLLSLYVSASLSYLLYSDILLKFSQTEITTPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29782 - protein, 466 aa, Artificial Sequence; identical to SEQ ID NO: 29770
  neuraminidase__InfluenzaB__AGX23626

SEQ ID NO: 29783 - protein, 466 aa, Artificial Sequence; identical to SEQ ID NO: 29147
  neuraminidase__InfluenzaB__AGX23637

SEQ ID NO: 29784 - protein, 466 aa, Artificial Sequence; identical to SEQ ID NO: 28788
  neuraminidase__InfluenzaB__AGX23659

SEQ ID NO: 29785 - protein, 466 aa, Artificial Sequence; identical to SEQ ID NO: 29147
  neuraminidase__InfluenzaB__AGX23670

SEQ ID NO: 29786 - protein, 466 aa, Artificial Sequence; identical to SEQ ID NO: 29147
  neuraminidase__InfluenzaB__AGX23681

SEQ ID NO: 29787 - protein, 466 aa, Artificial Sequence; identical to SEQ ID NO: 29147
  neuraminidase__InfluenzaB__AGX23692

SEQ ID NO: 29788 - protein, 466 aa, Artificial Sequence; identical to SEQ ID NO: 29147
  neuraminidase__InfluenzaB__AGX23703

SEQ ID NO: 29789 - protein, 466 aa, Artificial Sequence
  neuraminidase__InfluenzaB__AGX23714
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYVGVDGPDSNALLKIKYGEAYTDTYHSYEKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCGSDGDKGSGGIKGGFVHQRMASKIGRWYSRTMSKTKRMGMGLYVKYDGDPWTDSEALALSGVMVSMDEPGWYSFGFEIKDKKCDVPCIGIEMVHDGGKTTWHSAATAIYCLMGSGQLLWDTVTGVDMAL

SEQ ID NO: 29790 - protein, 466 aa, Artificial Sequence; identical to SEQ ID NO: 29147
  neuraminidase__InfluenzaB__AGX23725

SEQ ID NO: 29791 - protein, 466 aa, Artificial Sequence; identical to SEQ ID NO: 29770
  neuraminidase__InfluenzaB__AGX23736

SEQ ID NO: 29792 - protein, 466 aa, Artificial Sequence; identical to SEQ ID NO: 29147
  neuraminidase__InfluenzaB__AGX23747

SEQ ID NO: 29793 - protein, 466 aa, Artificial Sequence; identical to SEQ ID NO: 29147
  neuraminidase__InfluenzaB__AGX23758

SEQ ID NO: 29794 - protein, 466 aa, Artificial Sequence; identical to SEQ ID NO: 29770
  neuraminidase__InfluenzaB__AGX23769

SEQ ID NO: 29795 - protein, 466 aa, Artificial Sequence
  neuraminidase__InfluenzaB__AGX23780
MLPSTIQTLTLLLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGVSECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29796 - protein, 466 aa, Artificial Sequence
  neuraminidase__InfluenzaB__AGX23791
MLPSTIQTLTLFLTSGGVLLSLYVSASLSYLLYSDILLKFSQTEITAPIMPLDCANASNAQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGVSECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29797 - protein, 466 aa, Artificial Sequence; identical to SEQ ID NO: 29770
  neuraminidase__InfluenzaB__AGX23802

SEQ ID NO: 29798 - protein, 466 aa, Artificial Sequence; identical to SEQ ID NO: 29770
  neuraminidase__InfluenzaB__AGX23813

SEQ ID NO: 29799 - protein, 466 aa, Artificial Sequence; identical to SEQ ID NO: 29770
  neuraminidase__InfluenzaB__AGX23824

SEQ ID NO: 29800 - protein, 466 aa, Artificial Sequence; identical to SEQ ID NO: 29770
  neuraminidase__InfluenzaB__AGX23846

SEQ ID NO: 29801 - protein, 466 aa, Artificial Sequence; identical to SEQ ID NO: 28788
  neuraminidase__InfluenzaB__AGX23857

SEQ ID NO: 29802 - protein, 466 aa, Artificial Sequence; identical to SEQ ID NO: 29770
  neuraminidase__InfluenzaB__AGX23868

SEQ ID NO: 29803 - protein, 466 aa, Artificial Sequence
  neuraminidase__InfluenzaB__AGX23879
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVETSIFHMAAWSGSACHDGKEWTYIGVDGPDSNALLKIKYGEAYTDTYHSYAKNILRTQESACNCIGGDCYLMITDGPASGVSECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29804 - protein, 466 aa, Artificial Sequence; identical to SEQ ID NO: 29770
  neuraminidase__InfluenzaB__AGX23890

SEQ ID NO: 29805 - protein, 466 aa, Artificial Sequence; identical to SEQ ID NO: 28788
  neuraminidase__InfluenzaB__AGX23901

SEQ ID NO: 29806 - protein, 466 aa, Artificial Sequence
  neuraminidase__InfluenzaB__AGX23912
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNRLRHLISVKLGKIPTVENSIFHMAAWSGSACHDGKEWTYVGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCGSDGDKGSGGIKGGFVHQRMASKIGRWYSRTMSKTKRMGMGLYVKYDGDPWTDSEALALSGVMVSMDEPGWYSFGFEIKDKKCDVPCIGIEMVHDGGKTTWHSAATAIYCLMGSGQLLWDTVTGVDMAL

SEQ ID NO: 29807 - protein, 466 aa, Artificial Sequence; identical to SEQ ID NO: 28960
  neuraminidase__InfluenzaB__AGX23934

SEQ ID NO: 29808 - protein, 466 aa, Artificial Sequence
  neuraminidase__InfluenzaB__AGX23945
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYVGVDGPDSNALLKIKYGEAYTDTYHSYAKNILRTQESACNCIGGDCYLMITDGPASGISECRFLKIREGRIIKEIFPTGRIKHTEECTCGFASNKTIECACRDNSYTAKRPFVKLNVETDTAEIRLMCTETYLDTPRPNDGSITGPCGSDGDKGSGGIKGGFVHQRMASKIGRWYSRTMSKTKRMGMGLYVKYDGDPWTDSEALALSGVMVSMDEPGWYSFGFEIKDKKCDVPCIGIEMVHDGGKTTWHSAATAIYCLMGSGQLLWDTVTGVDMAL

SEQ ID NO: 29809 - protein, 466 aa, Artificial Sequence
  neuraminidase__InfluenzaB__AGX23956
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGIDGPDSNALLKIKYGEAYTDTYHSYAKNILRTQESACNCIGGDCYLMITDGPASGVSECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29810 - protein, 466 aa, Artificial Sequence; identical to SEQ ID NO: 29147
  neuraminidase__InfluenzaB__AGX23967

SEQ ID NO: 29811 - protein, 466 aa, Artificial Sequence; identical to SEQ ID NO: 28960
  neuraminidase__InfluenzaB__AGX23978

SEQ ID NO: 29812 - protein, 466 aa, Artificial Sequence
  neuraminidase__InfluenzaB__AGX23989
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNRYTAKRPFVKLNVETDKAEIRLMCTETYLDTPRPNDGSITGPCESDGDKGSGGIKGGFVHQRMASKIGRWYSRTMSKTKRMGMGLYVKYDGDPWTDSGALALSGVMVSIEEPGWYSFGFEIKDKKCDVPCIGIEMVHDGGKTTWHSAATAIYCLMGSGQLLWDTVTGVDMAL

SEQ ID NO: 29813 - protein, 466 aa, Artificial Sequence; identical to SEQ ID NO: 29770
  neuraminidase__InfluenzaB__AGX24000

SEQ ID NO: 29814 - protein, 466 aa, Artificial Sequence
  neuraminidase__InfluenzaB__AGX24011
MLPSTIQTLTLFLTSGGVLLSLYVSASLSYLLYSDILLKFSQTEITAPIMPLDYANASNVQAVNHSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYIDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29815 - protein, 466 aa, Artificial Sequence; identical to SEQ ID NO: 28960
  neuraminidase__InfluenzaB__AGX24022

SEQ ID NO: 29816 - protein, 466 aa, Artificial Sequence
  neuraminidase__InfluenzaB__AGX24033
MLPSTIQTLTLFLTSGGVLLSLYVSASLSYLLYSDILLKFSQTEITAQIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNRYTAKRPFVKLNVETDKAEIRLMCTETYLDTPRPNDGSITGPCESDGDKGSGGIKGGFVHQRMASKIGRWYSRTMSKTKRMGMGLYVKYDGDPWTDSGALALSGVMVSIEEPGWYSFGFEIKDKKCDVPCIGIEMVHDGGKTTWHSAATAIYCLMGSGQLLWDTVTGVDMAL

SEQ ID NO: 29817 - protein, 466 aa, Artificial Sequence; identical to SEQ ID NO: 28960
  neuraminidase__InfluenzaB__AGX24044

SEQ ID NO: 29818 - protein, 466 aa, Artificial Sequence
  neuraminidase__InfluenzaB__AGX24055
MLPSTIQTLTLFLTSGGVLLSLYVSASLSYLLYSDILLKFSQTEITAPIMPLDCANASNVQAVNRSATKGVTLLLPELEWTYPRLSCPGSTFQKALLISPHRFGETKGNSAPLIIREPFVACGPTECKHFALTHYAAQPGGYYNGTREDRNKLRHLISVKLGKIPTVENSIFHMAAWSGSACHDGKEWTYIGVDGPNSNALLKIKYGEAYTDTYHSYAKNILRTQESACNCIGGDCYLMITDGPASGVSECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29819 - protein, 466 aa, Artificial Sequence; identical to SEQ ID NO: 28817
  neuraminidase__InfluenzaB__AGX24066

SEQ ID NO: 29820 - protein, 466 aa, Artificial Sequence
  neuraminidase__InfluenzaB__AGX24077
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGNCYLMITDGPASGISECRFLKIREGRIIKEIFPTGRVKHTEECTCGFASNKTIECACRDNRYTAKRPFVKLNVETDKAEIRLMCTETYLDTPRPNDGSITGPCESDGDKGSGGIKGGFVHQRMASKIGRWYSRTMSKTKRMGMGLYVKYDGDPWADSGALALSGVMVSIEEPGWYSFGFEIKDKKCDVPCIGIEMVHDGGKTTWHSAATAIYCLMGSGQLLWDTVTGVDMAL

SEQ ID NO: 29821 - protein, 466 aa, Artificial Sequence
  neuraminidase__InfluenzaB__AGX24088
MLPSTIQTLTLFITSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYVGVDGPDSDALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCGSDGDKGSGGIKGGFVHQRMASKIGRWYSRTMSKTKRMGMGLYVKYDGDPWTDSEALALSGVMVSMDEPGWYSFGFEIKDKKCDVPCIGIEMVHDGGKTTWHSAATAIYCLMGSGQLLWDTVTGVDMAL

SEQ ID NO: 29822 - protein, 466 aa, Artificial Sequence; identical to SEQ ID NO: 28960
  neuraminidase__InfluenzaB__AGX24099

SEQ ID NO: 29823 - protein, 466 aa, Artificial Sequence
  neuraminidase__InfluenzaB__AGX24110
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYVGVDGPDSNALLKIKYGEAYTDTYHSYAKNILRTQESACNCIGGDCYLMITDGPASGISECRFLKIREGRIIKEIFPTGRVKHTEECTCGFASNKTIECTCRDNSYTAKRPFVKLNVETDTAEIRLMCTETYLDTPRPNDGSITGPCGSDGDKGSGGIKGGFVHQRMASKIGRWYSRTMSKTKRMGMGLYVKYDGDPWTDSEALALSGVMVSMDEPGWYSFGFEIKDKKCDVPCIGIEMVHDGGKTTWHSAATAIYCLMGSGQLLWDTVTGVDMAL

SEQ ID NO: 29824 - protein, 466 aa, Artificial Sequence
  neuraminidase__InfluenzaB__AGX24121
MLPSTIQTLTLFLTSGGVLLSLYVSASLSYLLYSDILLKFSQTEITAPIMPLDYANASNVQAVNHSAAKGVTLLLPEPEWTYPRLSCPGSTFQKALLISPHRFGETKGNSAPLIIREPFIACGPTECKHFALTHYAAKPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29825 - protein, 466 aa, Artificial Sequence
  neuraminidase__InfluenzaB__AGX24132
MLPSTIQTLTLFLTSGGVLLSLYVSASLSYLLYSDILLKFSRTEITAPIMPLDCANASNVQAVNRSATKGVTLPLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPALGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 29826 - protein, 466 aa, Artificial Sequence
  neuraminidase__InfluenzaB__AGX24143
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDGNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29827 - protein, 466 aa, Artificial Sequence; identical to SEQ ID NO: 28960
  neuraminidase__InfluenzaB__AGX24154

SEQ ID NO: 29828 - protein, 466 aa, Artificial Sequence
  neuraminidase__InfluenzaB__AGX24165
MLPSTIQTLTLFLTSGGVLLSLYVSASLSYLLYSDILLKFSQTEITAPIMPLDYANASNVQAVNHSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALNGVMVSMEEPGWYSFGFEIKDKKCDVPCIGIEMVHDGGKTTWHSAATAIYCLMGSGQLLWDTVTGVDMAL

SEQ ID NO: 29829 - protein, 466 aa, Artificial Sequence; identical to SEQ ID NO: 28817
  neuraminidase__InfluenzaB__AGX24176

SEQ ID NO: 29830 - protein, 466 aa, Artificial Sequence; identical to SEQ ID NO: 28817
  neuraminidase__InfluenzaB__AGX24187

SEQ ID NO: 29831 - protein, 466 aa, Artificial Sequence; identical to SEQ ID NO: 28817
  neuraminidase__InfluenzaB__AGX24198

SEQ ID NO: 29832 - protein, 466 aa, Artificial Sequence; identical to SEQ ID NO: 29147
  neuraminidase__InfluenzaB__AGX24231

SEQ ID NO: 29833 - protein, 466 aa, Artificial Sequence; identical to SEQ ID NO: 28817
  neuraminidase__InfluenzaB__AGX24242

SEQ ID NO: 29834 - protein, 466 aa, Artificial Sequence
  neuraminidase__InfluenzaB__AGX24275
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNRTIECACRDNSYTAKRPFVKLNVETDTAEIRLMCTETYLDTPRPNDGSITGPCESDGDKGSGGIKGGFVHQRMASKIGRWYSRTMSKTRRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29835 - protein, 466 aa, Artificial Sequence; identical to SEQ ID NO: 29412
  neuraminidase__InfluenzaB__AGX24286

SEQ ID NO: 29836 - protein, 466 aa, Artificial Sequence
  neuraminidase__InfluenzaB__AGX24297
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETRGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29837 - protein, 466 aa, Artificial Sequence; identical to SEQ ID NO: 29412
  neuraminidase__InfluenzaB__AGX24319

SEQ ID NO: 29838 - protein, 466 aa, Artificial Sequence
  neuraminidase__InfluenzaB__AGX24330
MLPSTIQTLTLFLTSGGVLLSLYVSASLSYLLYSDILLKFSQTEITAPIMPLDYANASNVQAVNHSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECTCRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMISMEEPGWYSFGFEIKDKKCDVPCIGIEMVHDGGKTTWYSAATAIYCLMGSGQLLWDTVTGVDMAL

SEQ ID NO: 29839 - protein, 466 aa, Artificial Sequence
  neuraminidase__InfluenzaB__AGX24341
MLPSTIQTLTLFLTSGGVLLSLYVSASLSYLLYSDILLKFSRTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALTLSGVMVSMEEPGWYSFGFEIKDKKCDVPCIGIEMVHDGGKTTWHSAATAIYCLMGSGQLLWDTVTGVNMTL

SEQ ID NO: 29840 - protein, 466 aa, Artificial Sequence
  neuraminidase__InfluenzaB__AGX24352
MLPSTIQTLTLFLTSGGVLLSLYVSASLSYLLYSDILLKFSRTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDNNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 29841 - protein, 466 aa, Artificial Sequence; identical to SEQ ID NO: 29836
  neuraminidase__InfluenzaB__AGX24363

SEQ ID NO: 29842 - protein, 466 aa, Artificial Sequence; identical to SEQ ID NO: 29840
  neuraminidase__InfluenzaB__AGX24374

SEQ ID NO: 29843 - protein, 466 aa, Artificial Sequence
  neuraminidase__InfluenzaB__AGX24385
MLPSTIQTLTLFLTSGGVLLSLYVSASLSYLLYSDILLKFSRTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 29844 - protein, 466 aa, Artificial Sequence
  neuraminidase__InfluenzaB__AGX24396
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNRYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSGALALSGVMVSIEEPGWYSFGFEIKDKKCDVPCIGIEMVHDGGKTTWHSAATAIYCLMGSGQLLWDTVTGVDMAL

SEQ ID NO: 29845 - protein, 466 aa, Artificial Sequence; identical to SEQ ID NO: 29844
  neuraminidase__InfluenzaB__AGX24407

SEQ ID NO: 29846 - protein, 466 aa, Artificial Sequence; identical to SEQ ID NO: 28817
  neuraminidase__InfluenzaB__AGX24418

SEQ ID NO: 29847 - protein, 466 aa, Artificial Sequence; identical to SEQ ID NO: 28788
  neuraminidase__InfluenzaB__AGX24429

SEQ ID NO: 29848 - protein, 466 aa, Artificial Sequence
  neuraminidase__InfluenzaB__AGX24440
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGTTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNRYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSGALALSGVMVSIEEPGWYSFGFEIKDKKCDVPCIGIEMVHDGGKTTWHSAATTIYCLMGSGQLLWDTVTGVDMAL

SEQ ID NO: 29849 - protein, 466 aa, Artificial Sequence; identical to SEQ ID NO: 29412
  neuraminidase__InfluenzaB__AGX24451

SEQ ID NO: 29850 - protein, 466 aa, Artificial Sequence
  neuraminidase__InfluenzaB__AGX24462
MLPSTIQTLTLFLTSGGVLLSLYVSASLSYLLYSDILLKFSQTEITAPIMPLDYANASNVQAVNHSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMISMEEPGWYSFGFEIKDKKCDVPCIGIEMVHDGGKTTWHSAATAIYCLMGSGQLLWDTVTGVDMAL

SEQ ID NO: 29851 - protein, 466 aa, Artificial Sequence; identical to SEQ ID NO: 29850
  neuraminidase__InfluenzaB__AGX24473

SEQ ID NO: 29852 - protein, 466 aa, Artificial Sequence
  neuraminidase__InfluenzaB__AGX24484
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNGYTAKRPFVKLNVETDTAEIRLMCTETYLDTPRPNDGSITGPCESDGDKGSGGIKGGFVHQRMASKIGRWYSRTMSKTRRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29853 - protein, 466 aa, Artificial Sequence
  neuraminidase__InfluenzaB__AGX24495
MLPSTIQTLTLFLTSGGVLLSLYVSASLSYLLYSDILLKFSQTEITAPIMPLDCANASNVQVVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTRRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29854 - protein, 466 aa, Artificial Sequence; identical to SEQ ID NO: 29412
  neuraminidase__InfluenzaB__AGX24506

SEQ ID NO: 29855 - protein, 466 aa, Artificial Sequence
  neuraminidase__InfluenzaB__AGX24517
MLPSTIQTLTLFLTSGGVLLSLYVSASLSYLLYSDILLKFSQTEITAPIMPLDCANASNVQAVNHSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGVSECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29856 - protein, 466 aa, Artificial Sequence; identical to SEQ ID NO: 29412
  neuraminidase__InfluenzaB__AGX24528

SEQ ID NO: 29857 - protein, 466 aa, Artificial Sequence; identical to SEQ ID NO: 29840
  neuraminidase__InfluenzaB__AGX24539

SEQ ID NO: 29858 - protein, 466 aa, Artificial Sequence
  neuraminidase__InfluenzaB__AGX24550
MLPSTIQTLTLFLTSGGVLLSLYVSASLSYLLYSDILLKFSQTEITAPIMPLDCANASNVQAVNRSAAKGVTLLIPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29859 - protein, 466 aa, Artificial Sequence; identical to SEQ ID NO: 29850
  neuraminidase__InfluenzaB__AGX24561

SEQ ID NO: 29860 - protein, 466 aa, Artificial Sequence; identical to SEQ ID NO: 28817
  neuraminidase__InfluenzaB__AGX24572

SEQ ID NO: 29861 - protein, 466 aa, Artificial Sequence
  neuraminidase__InfluenzaB__AGX24583
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTRRMGMGLYVKYDGDPWTDSGALALSGVMVSIEEPGWYSFGFEIKDKKCDVPCIGIEMVHDGGKTTWHSAATAIYCLMGSGQLLWDTVTGVDMAL

SEQ ID NO: 29862 - protein, 466 aa, Artificial Sequence; identical to SEQ ID NO: 29412
  neuraminidase__InfluenzaB__AGX24594

SEQ ID NO: 29863 - protein, 466 aa, Artificial Sequence; identical to SEQ ID NO: 29412
  neuraminidase__InfluenzaB__AGX24605

SEQ ID NO: 29864 - protein, 466 aa, Artificial Sequence; identical to SEQ ID NO: 29412
  neuraminidase__InfluenzaB__AGX24616

SEQ ID NO: 29865 - protein, 466 aa, Artificial Sequence; identical to SEQ ID NO: 29836
  neuraminidase__InfluenzaB__AGX24627

SEQ ID NO: 29866 - protein, 466 aa, Artificial Sequence; identical to SEQ ID NO: 29412
  neuraminidase__InfluenzaB__AGX24638

SEQ ID NO: 29867 - protein, 466 aa, Artificial Sequence
  neuraminidase__InfluenzaB__AGX24660
MLPSTIQTLTLFLTSGGVLLSLYVSASLSYLLYSDILLKFSRTEITAPIMPLDCANASNVQAVNRSATKGVTLLLPEPEWTYPRLSCPGSTFQKALLISPHRFGETKGNSAPLIIREPFIACGPKECKHFALTYYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 29868 - protein, 466 aa, Artificial Sequence
  neuraminidase__InfluenzaB__AGX24671
MLPSTIQTLTLFLTSGGVLLLLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDIPCIGIEMVHDGGKTTWHSAATAIYCLMGSGQLLWDTVTGVDMAL

SEQ ID NO: 29869 - protein, 466 aa, Artificial Sequence
  neuraminidase__InfluenzaB__AGX24682
MLPSTIQTLTLFLTSGGVLLSLYVSASLSYLLYSDILLKFSRTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALVLSGVMVSMEEPGWYSFGFEIKDKKCDVPCIGIEMVHDGGKTTWHSAATAIYCLMGSGQLLWDTVTGVNMTL

SEQ ID NO: 29870 - protein, 466 aa, Artificial Sequence; identical to SEQ ID NO: 29412
  neuraminidase__InfluenzaB__AGX24693

SEQ ID NO: 29871 - protein, 466 aa, Artificial Sequence; identical to SEQ ID NO: 29412
  neuraminidase__InfluenzaB__AGX24704

SEQ ID NO: 29872 - protein, 466 aa, Artificial Sequence; identical to SEQ ID NO: 29412
  neuraminidase__InfluenzaB__AGX24715

SEQ ID NO: 29873 - protein, 466 aa, Artificial Sequence
  neuraminidase__InfluenzaB__AGX24737
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGTTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNRYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSGALALSGVMVSIEEPGWYSFGFEIKDKKCDVPCIGIEMVHDGGKTTWHSAATAIYCLMGSGQLLWDTVTGVDMAL

SEQ ID NO: 29874 - protein, 466 aa, Artificial Sequence
  neuraminidase__InfluenzaB__AGX24748
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGRYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAVYCLMGSGQLLWDTVTGVDMAL

SEQ ID NO: 29875 - protein, 466 aa, Artificial Sequence
  neuraminidase__InfluenzaB__AGX24759
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDIPCIGIEMVHDGGKTTWHSAATAIYCLMGSGQLLWDTVTGVDMAL

SEQ ID NO: 29876 - protein, 466 aa, Artificial Sequence; identical to SEQ ID NO: 29412
  neuraminidase__InfluenzaB__AGX24770

SEQ ID NO: 29877 - protein, 466 aa, Artificial Sequence; identical to SEQ ID NO: 29874
  neuraminidase__InfluenzaB__AGX24781

SEQ ID NO: 29878 - protein, 466 aa, Artificial Sequence; identical to SEQ ID NO: 28788
  neuraminidase__InfluenzaB__AGX24792

SEQ ID NO: 29879 - protein, 466 aa, Artificial Sequence; identical to SEQ ID NO: 29836
  neuraminidase__InfluenzaB__AGX24803

SEQ ID NO: 29880 - protein, 466 aa, Artificial Sequence; identical to SEQ ID NO: 29412
  neuraminidase__InfluenzaB__AGX24814

SEQ ID NO: 29881 - protein, 466 aa, Artificial Sequence
  neuraminidase__InfluenzaB__AGX24825
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGEYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTRRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29882 - protein, 466 aa, Artificial Sequence; identical to SEQ ID NO: 29412
  neuraminidase__InfluenzaB__AGX24836

SEQ ID NO: 29883 - protein, 466 aa, Artificial Sequence
  neuraminidase__InfluenzaB__AGX24847
MLPSTIQTLTLFLTSGGVLLSLYVSASLSYLLYSDILLKFSRTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAVYCLMGSGQLLWDTVTGVNMTL

SEQ ID NO: 29884 - protein, 466 aa, Artificial Sequence; identical to SEQ ID NO: 28896
  neuraminidase__InfluenzaB__AGX24858

SEQ ID NO: 29885 - protein, 466 aa, Artificial Sequence
  neuraminidase__InfluenzaB__AGX24869
MLPSTIQTLTLFLTSGGVLLSLYVSASLSYLLYSDILLKFSRTEMTAPIMPLGCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 29886 - protein, 466 aa, Artificial Sequence
  neuraminidase__InfluenzaB__AGX24880
MLPSTIQMLTLFLTSGGVLLSLYVSASLSYLLYSDILLKFSRTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 29887 - protein, 466 aa, Artificial Sequence
  neuraminidase__InfluenzaB__AGX24902
MLPSTIQTLTLFLTSGGVLLSLYVSALLSYLLYSDILLKFSRTEITAPIMPLDCANASNVQAVNRSATKGVTLLLPEPEWTYPRLSCPGSTFQKALLISPHRFGENKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNNYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 29888 - protein, 466 aa, Artificial Sequence; identical to SEQ ID NO: 28901
  neuraminidase__InfluenzaB__AGX84846

SEQ ID NO: 29889 - protein, 466 aa, Artificial Sequence; identical to SEQ ID NO: 28956
  neuraminidase__InfluenzaB__AGX84858

SEQ ID NO: 29890 - protein, 466 aa, Artificial Sequence; identical to SEQ ID NO: 28901
  neuraminidase__InfluenzaB__AGX84869

SEQ ID NO: 29891 - protein, 466 aa, Artificial Sequence
  neuraminidase__InfluenzaB__AGX84880
MLPSTIQTLTLFLTSGGVLLSLYVSASLSYLLYSDILLKFSPTEITAPTMSLDCANASNVQAVNRSATKGVIFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29892 - protein, 466 aa, Artificial Sequence; identical to SEQ ID NO: 28901
  neuraminidase__InfluenzaB__AGX84891

SEQ ID NO: 29893 - protein, 466 aa, Artificial Sequence; identical to SEQ ID NO: 28956
  neuraminidase__InfluenzaB__AGX84902

SEQ ID NO: 29894 - protein, 466 aa, Artificial Sequence
  neuraminidase__InfluenzaB__AGX84924
MLPSTIQTLTLFLTSGGVLLSLYVSALLSYLLYSDILLKFSPTEITAPTMSLDYANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29895 - protein, 466 aa, Artificial Sequence
  neuraminidase__InfluenzaB__AGY46393
MLPSTIQTLTLFLTSGGVLLSLYVSASLSYLLYSDILLKFPSTEITAPTMPLDCANATNVQAVNRSATKGVTLLLPEPEWTYPRLSCPGSTFQKALLISPHRFGEIKGNSAPLIIREPFIACGPNECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTERMGMGLYVKYDGDPWADSDALAFSGVMVSMEEPGWYSFGFEIKDKKCDVPCIGIEMVHDGGKETWHSAATAIYCLMGSGQLLWDTVTGVNMAL

SEQ ID NO: 29896 - protein, 466 aa, Artificial Sequence
  neuraminidase__InfluenzaB__AGY46397
MLPSTIQTLTLFLTSGGVLLSLYVSASLSYLLYSDILLKFSRTEITAPIMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKTTWHSAATAIYCLMGSGQLLWDTVTGVNMTL

SEQ ID NO: 29897 - protein, 466 aa, Artificial Sequence
  neuraminidase__InfluenzaB__AGY46399
MLPSTIQTLTLFLTSGGVLLSLYVSASLSYLLYSDILLKFSPTEIIAPTTPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWADSEALALSGVMVSMEEPGWYSFGFEIKDKKCDVPCIGIEMVHDGGKETWHSAATAIYCLMGSGQLLWDTVTGVDMAL

SEQ ID NO: 29898 - protein, 466 aa, Artificial Sequence
  neuraminidase__InfluenzaB__AGY46401
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29899 - protein, 466 aa, Artificial Sequence; identical to SEQ ID NO: 28616
  neuraminidase__InfluenzaB__AGZ59825

SEQ ID NO: 29900 - protein, 466 aa, Artificial Sequence; identical to SEQ ID NO: 28682
  neuraminidase__InfluenzaB__AGZ59836

SEQ ID NO: 29901 - protein, 466 aa, Artificial Sequence; identical to SEQ ID NO: 29371
  neuraminidase__InfluenzaB__AGZ59847

SEQ ID NO: 29902 - protein, 466 aa, Artificial Sequence
  neuraminidase__InfluenzaB__AGZ59858
MLPSTIQTLTLFLTSGGVLLSLYVSASLSYLLYSDILLKFSPTEITAPTMPLDCANASNVHAVNRSATKGVTLLLPEPEWTYPRLSCPGSTFQKALLISPHRFGETKGNSAPLIIREPFIACGPNECKHFALTHYAAQPGGYYNGKRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29903 - protein, 466 aa, Artificial Sequence
  neuraminidase__InfluenzaB__AGZ59869
MLPSTIQTLTLFLTSGGVLLSLYVSASLSYLLYSDILLKFSPTEITAPTMPLDCANASNVQAVNRSATKGVTLLLPEPEWTYPRLSCPGSTFQKAVLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29904 - protein, 466 aa, Artificial Sequence; identical to SEQ ID NO: 29400
  neuraminidase__InfluenzaB__AGZ59880

SEQ ID NO: 29905 - protein, 466 aa, Artificial Sequence; identical to SEQ ID NO: 29844
  neuraminidase__InfluenzaB__AGZ59891

SEQ ID NO: 29906 - protein, 466 aa, Artificial Sequence; identical to SEQ ID NO: 28961
  neuraminidase__InfluenzaB__AGZ59902

SEQ ID NO: 29907 - protein, 466 aa, Artificial Sequence; identical to SEQ ID NO: 28961
  neuraminidase__InfluenzaB__AGZ59913

SEQ ID NO: 29908 - protein, 466 aa, Artificial Sequence; identical to SEQ ID NO: 28961
  neuraminidase__InfluenzaB__AGZ59924

SEQ ID NO: 29909 - protein, 466 aa, Artificial Sequence; identical to SEQ ID NO: 28961
  neuraminidase__InfluenzaB__AGZ59935

SEQ ID NO: 29910 - protein, 466 aa, Artificial Sequence; identical to SEQ ID NO: 28961
  neuraminidase__InfluenzaB__AGZ59946

SEQ ID NO: 29911 - protein, 466 aa, Artificial Sequence
  neuraminidase__InfluenzaB__AGZ59957
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKGTWHSAATAIYCLMGSGQLLWDTVTGVDMAL

SEQ ID NO: 29912 - protein, 466 aa, Artificial Sequence; identical to SEQ ID NO: 28961
  neuraminidase__InfluenzaB__AGZ59969

SEQ ID NO: 29913 - protein, 466 aa, Artificial Sequence; identical to SEQ ID NO: 28961
  neuraminidase__InfluenzaB__AGZ59980

SEQ ID NO: 29914 - protein, 466 aa, Artificial Sequence; identical to SEQ ID NO: 28961
  neuraminidase__InfluenzaB__AGZ59991

SEQ ID NO: 29915 - protein, 466 aa, Artificial Sequence; identical to SEQ ID NO: 28961
  neuraminidase__InfluenzaB__AGZ60003

SEQ ID NO: 29916 - protein, 466 aa, Artificial Sequence
  neuraminidase__InfluenzaB__AGZ60014
MLPSTIQTLTLFLTSGGVLLSLYVSALLSYLLYSDILLKFSPTEITAPTMSLDCANASNVQAVNRSATKGVTFLLPEPEWTYPRLSCPGSTFQRALLISPHRFGEAKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGQIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 29917 - protein, 466 aa, Artificial Sequence; identical to SEQ ID NO: 28895
  neuraminidase__InfluenzaB__AGZ60025

SEQ ID NO: 29918 - protein, 466 aa, Artificial Sequence
  neuraminidase__InfluenzaB__AGZ60037
MLPSTIQTLTLFLTSGGVLLSLYVSALLSYLLYSDILLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWAESDALAFSGVMVSMKEPGWYSFGFEIKDKKCDVPCIGIEMVHDGGKETWHSAATAIYCLMGSGQLLWDTVTGVDIAL

SEQ ID NO: 29919 - protein, 466 aa, Artificial Sequence; identical to SEQ ID NO: 29131
  neuraminidase__InfluenzaB__AGZ60048

SEQ ID NO: 29920 - protein, 466 aa, Artificial Sequence; identical to SEQ ID NO: 29131
  neuraminidase__InfluenzaB__AGZ60059

SEQ ID NO: 29921 - protein, 466 aa, Artificial Sequence
  neuraminidase__InfluenzaB__AGZ60070
MLPSTIQTLTLFLTSGGVLLSLYVSASLSYLLYSDILLKFSTTEITAPTMPLDCANASNVQAVNHSAAKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYAHNILRTQESACNCIGGNCYLMITDGSASGISECRFLKIREGRIIKEIFPTGRVKHTEECTCGFANNKTIECACRDNSYTAKRPFVKLNVETDTAEIRLMCTETYLDTPRPDDGSITGPCESNGNKGSGGIKGGFVHQRMASKIGRWYSRTMSKTKRMGMGLYVKYDGDPWTDSDALVFSGVMISVEEPGWYSFGFEIKDKKCDVPCIGIEMVHDGGKETWHSAATAIYCLMGSGQLLWDTVTGVNMTL

SEQ ID NO: 29922 - protein, 466 aa, Artificial Sequence; identical to SEQ ID NO: 28627
  neuraminidase__InfluenzaB__AGZ60081

SEQ ID NO: 29923 - protein, 466 aa, Artificial Sequence; identical to SEQ ID NO: 29147
  neuraminidase__InfluenzaB__AGZ60092

SEQ ID NO: 29924 - protein, 466 aa, Artificial Sequence; identical to SEQ ID NO: 29770
  neuraminidase__InfluenzaB__AGZ60103

SEQ ID NO: 29925 - protein, 466 aa, Artificial Sequence; identical to SEQ ID NO: 28788
  neuraminidase__InfluenzaB__AGZ60135

SEQ ID NO: 29926 - protein, 466 aa, Artificial Sequence; identical to SEQ ID NO: 28960
  neuraminidase__InfluenzaB__AGZ60154

SEQ ID NO: 29927 - protein, 466 aa, Artificial Sequence
  neuraminidase__InfluenzaB__AGZ60164
MLPSTTQTLTLFLTSGGVLLSLYVSASLSYLLYSDILLKFSQTEITAPIMPLDCANASNVQAVNRSAAKGVTLLLPEPEWTYPRLSCPGSTFQKALLINPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29928 - protein, 466 aa, Artificial Sequence; identical to SEQ ID NO: 29840
  neuraminidase__InfluenzaB__AGZ60176

SEQ ID NO: 29929 - protein, 466 aa, Artificial Sequence; identical to SEQ ID NO: 28817
  neuraminidase__InfluenzaB__AGZ60187

SEQ ID NO: 29930 - protein, 466 aa, Artificial Sequence; identical to SEQ ID NO: 28817
  neuraminidase__InfluenzaB__AGZ60198

SEQ ID NO: 29931 - protein, 466 aa, Artificial Sequence; identical to SEQ ID NO: 28817
  neuraminidase__InfluenzaB__AGZ60210

SEQ ID NO: 29932 - protein, 466 aa, Artificial Sequence
  neuraminidase__InfluenzaB__AGZ60221
MLPTTIQTLTLFLTSGGVLLSLYVSASLSYLLYSDILLKFSRTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 29933 - protein, 466 aa, Artificial Sequence
  neuraminidase__InfluenzaB__AGZ60272
MLPSTIQTLTLFLTSGGVLLSLYVSASLSYLLYSDILLKFSQTEITAPIMPLDCANASNVQAVNRSAAKGVTLLLPKPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29934 - protein, 465 aa, Artificial Sequence
  neuraminidase__InfluenzaB__AHL91182
MLPSTIQTLTLFLTSGGVLLSLYVSALLSYLLYSDILLKFSPKIIAPTMSLDCANASNVQAVNHSATKEMKFLPPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGRGGVKGGFVHQRMASKIGRWYSRTMSKTKRMGMELYVKYDGDPWTDSDALAPSGVMVSMEEPGWYSFGFEIKDKKCDVPCIGIEMVHDGGKRTWHSAATAIYCLMGSGQLLWDTVTGVDMAL

SEQ ID NO: 29935 - protein, 465 aa, Artificial Sequence
  neuraminidase__InfluenzaB__AHL91193
MLPSTIQTLTLFLTSGGVLLSLYVSALLSYLLYSDILLKFSPKIIAPTMSLDCANASNVQAVNHSATKEMKFLPSEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGRGGVKGGFVHQRMASKIGRWYSRTMSKTKRMGMELYVKYDGDPWTDSDALAPSGVMVSMEEPGWYSFGFEIKDKKCDVPCIGIEMVHDGGKRTWHSAATAIYCLMGSGQLLWDTVTGVDMAL

SEQ ID NO: 29936 - protein, 465 aa, Artificial Sequence
  neuraminidase__InfluenzaB__AHL91204
MLPSTIQTLTLFLTSGGVLLSLYVSALLSYLLYSDVLLKFSPKIIAPTMSLDCANASNVQAVNHSATEEMTFLLPEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNIYTAKRPFVKLNVETDTAEIRLMCTETYLDTPRPDDGSITGPCESNGDKGHGGIKGGFVHQRMASKIGRWYSRTMSKTKRMGMELYVKYDGDPWTDSDALAPSGVMVSMEEPGWYSFGFEIKDKKCDVPCIGIEMVHDGGKKTWHSAATAIYCLMGSGQLLWDTVTGVDMAL

SEQ ID NO: 29937 - protein, 465 aa, Artificial Sequence
  neuraminidase__InfluenzaB__AHL91215
MLPSTIQTLTLFLTSGGVLLSLYVSTLLSYLLYSDILLKFSPKIIAPTTSLDCANASNVQAVNHSATKEMKFLPTEPEWTYPRLSCQGSTFQKALLISPHRFGEAKGNSAPLIIREPFIACGPKECKHFALTHYAAQPGGYYNGTREDRNKLRHLISVNLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGSGGVKGGFVHQRMTSKIGRWYSRTMSKTKRMGMELYVKYDGDPWTDSDALAPSGVMVSMEEPGWYSFGFEIKDKKCDVPCIGIEMVHDGGKRTWHSAATAIYCLMGSGQLLWDTVTGVDMAL

SEQ ID NO: 29938 - protein, 466 aa, Artificial Sequence; identical to SEQ ID NO: 28709
  neuraminidase__InfluenzaB__AHL91226

SEQ ID NO: 29939 - protein, 466 aa, Artificial Sequence; identical to SEQ ID NO: 28710
  neuraminidase__InfluenzaB__AHL91237

SEQ ID NO: 29940 - protein, 466 aa, Artificial Sequence; identical to SEQ ID NO: 28710
  neuraminidase__InfluenzaB__AHL91248

SEQ ID NO: 29941 - protein, 466 aa, Artificial Sequence; identical to SEQ ID NO: 28709
  neuraminidase__InfluenzaB__AHL91259

SEQ ID NO: 29942 - protein, 466 aa, Artificial Sequence; identical to SEQ ID NO: 28709
  neuraminidase__InfluenzaB__AHL91270

SEQ ID NO: 29943 - protein, 465 aa, Artificial Sequence; identical to SEQ ID NO: 28681
  neuraminidase__InfluenzaB__AHL91281

SEQ ID NO: 29944 - protein, 466 aa, Artificial Sequence
  neuraminidase__InfluenzaB__AHL91303
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGDCYLMITDGSASGINECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTRRMGMGLYVKYDGDPWTDSDALALSGVMVSMEEPGWYSFGFEIKDKKCDVPCIGIEMVHDGGKKTWHSAATAIYCLMGSGQLLWDTVTGVDMAL

SEQ ID NO: 29945 - protein, 466 aa, Artificial Sequence; identical to SEQ ID NO: 28710
  neuraminidase__InfluenzaB__AHL91314

SEQ ID NO: 29946 - protein, 466 aa, Artificial Sequence; identical to SEQ ID NO: 28710
  neuraminidase__InfluenzaB__AHL91325

SEQ ID NO: 29947 - protein, 466 aa, Artificial Sequence
  neuraminidase__InfluenzaB__AHL91347
MLPSTIQTLTLFLTSGGVLLSLYVSASLSYLLYSDVLLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYANNILRTQESACNCIGGDCYLMITDGSASGISECRFLKIREGRIVKEIFPTGRVEHTEECTCGFASNKTIECACRDNSYTAKRPFVKLNVETDTAEIRLMCTETYLDTPRPEDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 29948 - protein, 466 aa, Artificial Sequence; identical to SEQ ID NO: 29947
  neuraminidase__InfluenzaB__AHL91358

SEQ ID NO: 29949 - protein, 466 aa, Artificial Sequence; identical to SEQ ID NO: 28685
  neuraminidase__InfluenzaB__AHL91369

SEQ ID NO: 29950 - protein, 466 aa, Artificial Sequence; identical to SEQ ID NO: 28685
  neuraminidase__InfluenzaB__AHL91380

SEQ ID NO: 29951 - protein, 466 aa, Artificial Sequence
  neuraminidase__InfluenzaB__AHL91391
MLPSTIQTLTLFLTSGGVLLSLYVSASLSYLLYSDILLKFSPKEITAPTMPLNCANASNVQAVNRSATKGVTLPLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDNNALLKIKYGEAYTDTYHSYANNILRTQESACNCIGGDCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWIDSDALTLSGVMVSMEEPGWYSFGFEIKDKKCDVPCIGIEMVHDGGKTTWHSAATAIYCLMGSGQLLWDTVTGVDMAL

SEQ ID NO: 29952 - protein, 466 aa, Artificial Sequence
  neuraminidase__InfluenzaB__AHL91413
MLPSTIQTLTLFLTSGGVLLSLYVSASLSYLLYSDILLKFTPTEITAPTMPLDCANASNVQAVNLSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGNKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 29953 - protein, 466 aa, Artificial Sequence
  neuraminidase__InfluenzaB__AHL91446
MLPSTIQTLTLFLTSGGVLLSLYVSASLSYLLYSDILLKFSPTEITAPTMPLDCANASNVQAVNRSATKGMTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGGKGSGGIKGGFVHQRMESKIGRWYSRTMSKTKRMGMGLYVKYDGDPWTDSDALALSGVMVSMEEPGWYSFGFEIKDKECDVPCIGIEMVHDGGKETWHSAATAIYCLMGSGQLLWDTVTGVNMAL

SEQ ID NO: 29954 - protein, 466 aa, Artificial Sequence
  neuraminidase__InfluenzaB__AHL91457
MLPSTIQTLTLFLTSGGVLLSLYVSASLSYLLYSDILLKFSPTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNTLRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGNKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 29955 - protein, 466 aa, Artificial Sequence
  neuraminidase__InfluenzaB__AHL91468
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSVGEPGWYSFGFEIKDKKCDVPCIGIEMVHDGGKETWHSAATAIYCLMGSGQLLWDTVTGVDMAL

SEQ ID NO: 29956 - protein, 466 aa, Artificial Sequence
  neuraminidase__InfluenzaB__AHL91479
MLPSTIQTLTLFLTSGGVLLSLYVSASLSYLLYSDILLKFSPTEITAPTMPSDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 29957 - protein, 466 aa, Artificial Sequence
  neuraminidase__InfluenzaB__AHL91501
MLPSTIQTLTLFLTSGGVLLSLYVSASLSYLLYSDILLKFSPTEITAPTMPLDCANASNVQAVNRSATKGMTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVEHTEECTCGFASNKTIECACRDNSYTAKRPFVKLNVETDTAEIRLMCTETYLDTPRPDDGSITGPCESNGGKGSGGIKGGFVHQRMESKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVNMAL

SEQ ID NO: 29958 - protein, 466 aa, Artificial Sequence
  neuraminidase__InfluenzaB__AHL91512
MLPSTIQTLTLFLTSGGVLLSLYVSASLSYLLYSDILLKFSPTEITAPTMPLDCANASNVQAVNRSATKGVTLLLPEPEWTYPRLSCPGSIFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 29959 - protein, 466 aa, Artificial Sequence
  neuraminidase__InfluenzaB__AHL91523
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 29960 - protein, 466 aa, Artificial Sequence; identical to SEQ ID NO: 29957
  neuraminidase__InfluenzaB__AHL91534

SEQ ID NO: 29961 - protein, 466 aa, Artificial Sequence
  neuraminidase__InfluenzaB__AHL91545
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMTSKIGRWYSRTMSKTKRMGMGLYVKYDGDPWTDSDALALSGVMVSMEEPGWYSFGFEIKDKKCDVPCIGIEMVHDGGKGTWHSAATAIYCLMGSGQLLWDTVTGVDMAL

SEQ ID NO: 29962 - protein, 466 aa, Artificial Sequence; identical to SEQ ID NO: 29957
  neuraminidase__InfluenzaB__AHL91556

SEQ ID NO: 29963 - protein, 466 aa, Artificial Sequence; identical to SEQ ID NO: 29957
  neuraminidase__InfluenzaB__AHL91578

SEQ ID NO: 29964 - protein, 466 aa, Artificial Sequence; identical to SEQ ID NO: 28885
  neuraminidase__InfluenzaB__AHL91589

SEQ ID NO: 29965 - protein, 466 aa, Artificial Sequence
  neuraminidase__InfluenzaB__AHL91600
MLPSTIQTLTLFLTTGGVLLSLYVSASLSYLLYSDILLKFSPTEITAPTMPLDCANASNVQAVNRSATKGVTFLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 29966 - protein, 466 aa, Artificial Sequence; identical to SEQ ID NO: 29965
  neuraminidase__InfluenzaB__AHL91611

SEQ ID NO: 29967 - protein, 466 aa, Artificial Sequence; identical to SEQ ID NO: 29957
  neuraminidase__InfluenzaB__AHL91622

SEQ ID NO: 29968 - protein, 466 aa, Artificial Sequence; identical to SEQ ID NO: 29958
  neuraminidase__InfluenzaB__AHL91633

SEQ ID NO: 29969 - protein, 466 aa, Artificial Sequence; identical to SEQ ID NO: 29958
  neuraminidase__InfluenzaB__AHL91644

SEQ ID NO: 29970 - protein, 466 aa, Artificial Sequence
  neuraminidase__InfluenzaB__AHL91655
MLPSTIQTLTLFLTSGGVLLSLYVSASLSYLLYSDILLKFSPTEITAPTMPLDCANASNVQAVNRSATKEVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 29971 - protein, 466 aa, Artificial Sequence; identical to SEQ ID NO: 29957
  neuraminidase__InfluenzaB__AHL91666

SEQ ID NO: 29972 - protein, 466 aa, Artificial Sequence; identical to SEQ ID NO: 29958
  neuraminidase__InfluenzaB__AHL91677

SEQ ID NO: 29973 - protein, 466 aa, Artificial Sequence; identical to SEQ ID NO: 29959
  neuraminidase__InfluenzaB__AHL91688

SEQ ID NO: 29974 - protein, 466 aa, Artificial Sequence; identical to SEQ ID NO: 28687
  neuraminidase__InfluenzaB__AHL91699

SEQ ID NO: 29975 - protein, 466 aa, Artificial Sequence
  neuraminidase__InfluenzaB__AHL91710
MLPSTIQTLTLFLTSGGVLLSLYVSASLSYLLYSDILLKFSPTEITAPTMPLDCANASNVQAVNHSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 29976 - protein, 466 aa, Artificial Sequence; identical to SEQ ID NO: 28614
  neuraminidase__InfluenzaB__AHL91721

SEQ ID NO: 29977 - protein, 466 aa, Artificial Sequence; identical to SEQ ID NO: 28682
  neuraminidase__InfluenzaB__AHL91732

SEQ ID NO: 29978 - protein, 466 aa, Artificial Sequence; identical to SEQ ID NO: 28614
  neuraminidase__InfluenzaB__AHL91743

SEQ ID NO: 29979 - protein, 466 aa, Artificial Sequence
  neuraminidase__InfluenzaB__AHL91754
MLPSTIQTLTLLLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 29980 - protein, 466 aa, Artificial Sequence; identical to SEQ ID NO: 28614
  neuraminidase__InfluenzaB__AHL91765

SEQ ID NO: 29981 - protein, 466 aa, Artificial Sequence
  neuraminidase__InfluenzaB__AHL91776
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVETSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29982 - protein, 466 aa, Artificial Sequence; identical to SEQ ID NO: 29981
  neuraminidase__InfluenzaB__AHL91787

SEQ ID NO: 29983 - protein, 466 aa, Artificial Sequence; identical to SEQ ID NO: 29981
  neuraminidase__InfluenzaB__AHL91798

SEQ ID NO: 29984 - protein, 466 aa, Artificial Sequence; identical to SEQ ID NO: 28618
  neuraminidase__InfluenzaB__AHL91809

SEQ ID NO: 29985 - protein, 466 aa, Artificial Sequence
  neuraminidase__InfluenzaB__AHL91820
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMVTDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMASKIGRWYSRTMSKTERMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29986 - protein, 466 aa, Artificial Sequence
  neuraminidase__InfluenzaB__AHL91831
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTETYLDTPRPDDGSITGPCESNGDKGSGGIKGGFVHQRMTSKIGRWYSRTMSKTERMGMGLYVKYDGDPWADSDALALSGVMVSMEEPGWYSFGFEIKDKKCDVPCIGIEMVHDGGKETWHSAATAIYCLMGSGQLLWDTVTGVDMAL

SEQ ID NO: 29987 - protein, 466 aa, Artificial Sequence; identical to SEQ ID NO: 29131
  neuraminidase__InfluenzaB__AHL91842

SEQ ID NO: 29988 - protein, 466 aa, Artificial Sequence
  neuraminidase__InfluenzaB__AHL91853
MLPSTIQTLTLFLTSGGVLLSLYVSASLSYLLYSDILLKFSTTEITAPTMPSDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYANNILRTQESACNCIGGNCYLMITDGSASGISECRFLKIREGRIIKEIFPTGRVKHTEECTCGFASNKTIECACRDNSYTAKRPFVKLNVETDTAEIRLMCTETYLDTPRPDDGSITGPCESNGNKGSGGIKGGFVHQRMASKIGRWYSRTMSKTKRMGMGLYVKYDGDPWTDSDALALSGVMVSMEEPGWYSFGFEIKDKKCDVPCIGIEMVHDGGKETWHSAATAIYCLMGSGQLLWDTVTGVDMAL

SEQ ID NO: 29989 - protein, 466 aa, Artificial Sequence; identical to SEQ ID NO: 29129
  neuraminidase__InfluenzaB__AHL91864

SEQ ID NO: 29990 - protein, 466 aa, Artificial Sequence; identical to SEQ ID NO: 29129
  neuraminidase__InfluenzaB__AHL91875

SEQ ID NO: 29991 - protein, 466 aa, Artificial Sequence; identical to SEQ ID NO: 28886
  neuraminidase__InfluenzaB__AHL91886

SEQ ID NO: 29992 - protein, 466 aa, Artificial Sequence; identical to SEQ ID NO: 28627
  neuraminidase__InfluenzaB__AHL91897

SEQ ID NO: 29993 - protein, 466 aa, Artificial Sequence; identical to SEQ ID NO: 28627
  neuraminidase__InfluenzaB__AHL91908

SEQ ID NO: 29994 - protein, 466 aa, Artificial Sequence
  neuraminidase__InfluenzaB__AHL91919
MLPSTIQTLTLFLTSGGVLLSLYVSASLSYLLYSDILLKFSQTEITAPIMPLDCANASNVQAVNRSATKGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 29995 - protein, 466 aa, Artificial Sequence; identical to SEQ ID NO: 29689
  neuraminidase__InfluenzaB__AHL91930

SEQ ID NO: 29996 - protein, 466 aa, Artificial Sequence; identical to SEQ ID NO: 28627
  neuraminidase__InfluenzaB__AHL91941

SEQ ID NO: 29997 - protein, 466 aa, Artificial Sequence; identical to SEQ ID NO: 28627
  neuraminidase__InfluenzaB__AHL91952

SEQ ID NO: 29998 - protein, 466 aa, Artificial Sequence; identical to SEQ ID NO: 28670
  neuraminidase__InfluenzaB__AHL91963

SEQ ID NO: 29999 - protein, 466 aa, Artificial Sequence
  neuraminidase__InfluenzaB__AHL91974
MLPSTIQTLTLFLTSGGVLLSLYVSASLSYLLYSDILLKFSPTEITTPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30000 - protein, 466 aa, Artificial Sequence; identical to SEQ ID NO: 28670
  neuraminidase__InfluenzaB__AHL91985

SEQ ID NO: 30001 - protein, 466 aa, Artificial Sequence; identical to SEQ ID NO: 28627
  neuraminidase__InfluenzaB__AHL91995

SEQ ID NO: 30002 - protein, 466 aa, Artificial Sequence
  neuraminidase__InfluenzaB__AHL92006
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGVEMVHDGGKETWHSAATAIYCLMGSGQLLWDTVTGVDMAL

SEQ ID NO: 30003 - protein, 466 aa, Artificial Sequence; identical to SEQ ID NO: 28635
  neuraminidase__InfluenzaB__AHL92017

SEQ ID NO: 30004 - protein, 466 aa, Artificial Sequence; identical to SEQ ID NO: 28635
  neuraminidase__InfluenzaB__AHL92028

SEQ ID NO: 30005 - protein, 466 aa, Artificial Sequence
  neuraminidase__InfluenzaB__AHL92039
MLPSTIQTLTLFLTSGGVLLSLYVSASLSYLLYSDILLKFSPTEITAPTMPLDCANASNVHAVNRSATKGVTLLLPEPEWIYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYNGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30006 - protein, 466 aa, Artificial Sequence; identical to SEQ ID NO: 28635
  neuraminidase__InfluenzaB__AHL92050

SEQ ID NO: 30007 - protein, 466 aa, Artificial Sequence
  neuraminidase__InfluenzaB__AHL92061
MLPSTTQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30008 - protein, 466 aa, Artificial Sequence
  neuraminidase__InfluenzaB__AHL92072
MLPSTIQTLTLFLTSGGVLLSLYVSASLSYLLYSDILLKFSPTEITAPTMPLDCANASNVQAVNHSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30009 - protein, 466 aa, Artificial Sequence; identical to SEQ ID NO: 30008
  neuraminidase__InfluenzaB__AHL92083

SEQ ID NO: 30010 - protein, 466 aa, Artificial Sequence; identical to SEQ ID NO: 30008
  neuraminidase__InfluenzaB__AHL92094

SEQ ID NO: 30011 - protein, 466 aa, Artificial Sequence
  neuraminidase__InfluenzaB__AHL92105
MLPSTIQTLTLFLTSGGVLLSLYVSASLSYLLYSDILLKFSPTEITAPTMPLDCANASNVHAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGGGGIKGGFVHQRMASKIGRWYSRTMSKTERMGMGLYVKYDGDPWADSDALAFSGVMVSLKEPGWYSFGFEIKDKKCDVPCIGIEMVHDGGKETWHSAATAIYCLMGSGQLLWDTVTGVDMAL

SEQ ID NO: 30012 - protein, 466 aa, Artificial Sequence; identical to SEQ ID NO: 28788
  neuraminidase__InfluenzaB__AHL92116

SEQ ID NO: 30013 - protein, 466 aa, Artificial Sequence; identical to SEQ ID NO: 30008
  neuraminidase__InfluenzaB__AHL92127

SEQ ID NO: 30014 - protein, 466 aa, Artificial Sequence; identical to SEQ ID NO: 30008
  neuraminidase__InfluenzaB__AHL92138

SEQ ID NO: 30015 - protein, 466 aa, Artificial Sequence; identical to SEQ ID NO: 30008
  neuraminidase__InfluenzaB__AHL92149

SEQ ID NO: 30016 - protein, 466 aa, Artificial Sequence
  neuraminidase__InfluenzaB__AHL92171
MLPSTIQTLTLFLTSGGVLLSLYVSASLSYLLYSDILLKFSPTEITAPTMPLDCANASNVQAVNHSATKGVTLLLPEPEWTYPRLSCPGSTFQKALLVSPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30017 - protein, 466 aa, Artificial Sequence
  neuraminidase__InfluenzaB__AHL92182
MLPSTIQTLTLFLTSGGVLLSLYVSASLSYLLYSDILLKFSPTEITAPTMPLDCANASNVHAVNRSATKGVTLLLPEPEWAYPRLSCPGSTFQKALLISPHRFGETKGNSAPLIIREPFIACGPNECKHFALTHYAAQPGGYYSGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30018 - protein, 466 aa, Artificial Sequence; identical to SEQ ID NO: 30017
  neuraminidase__InfluenzaB__AHL92193

SEQ ID NO: 30019 - protein, 466 aa, Artificial Sequence; identical to SEQ ID NO: 28788
  neuraminidase__InfluenzaB__AHL92204

SEQ ID NO: 30020 - protein, 466 aa, Artificial Sequence
  neuraminidase__InfluenzaB__AHL92215
MLPSTIQTLTLFLTSGGVLLSLYVSASLSYLLYSDILLKFSPTEITAPTMPLDCANASNVQAVNHSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPKGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30021 - protein, 466 aa, Artificial Sequence; identical to SEQ ID NO: 30008
  neuraminidase__InfluenzaB__AHL92226

SEQ ID NO: 30022 - protein, 466 aa, Artificial Sequence; identical to SEQ ID NO: 28788
  neuraminidase__InfluenzaB__AHL92237

SEQ ID NO: 30023 - protein, 466 aa, Artificial Sequence; identical to SEQ ID NO: 30008
  neuraminidase__InfluenzaB__AHL92248

SEQ ID NO: 30024 - protein, 466 aa, Artificial Sequence
  neuraminidase__InfluenzaB__AHL92259
MLPSTIQTLTLFLTSGGVLLSLYVSASLSYLLYSDILLKFSPTEITASTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMTSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30025 - protein, 466 aa, Artificial Sequence; identical to SEQ ID NO: 30008
  neuraminidase__InfluenzaB__AHL92270

SEQ ID NO: 30026 - protein, 466 aa, Artificial Sequence
  neuraminidase__InfluenzaB__AHL92281
MLPSTIQTLTLFLTSGGVLLSLYVSASLSYLLYSDILLKFSPTEITAPTMPLDCANASNVQAANHSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30027 - protein, 466 aa, Artificial Sequence
  neuraminidase__InfluenzaB__AHL92303
MLPSTIQTLTLFLTSGGVLLSLYVSASLSYLLYSDILLKFSPTEITAPTMPLDCANASNVHAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGNKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30028 - protein, 466 aa, Artificial Sequence
  neuraminidase__InfluenzaB__AHL92314
MLPSTIQTLTLFLTSGGVLLSLYVSASLSYLLYSDILLKFSQTKITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYVGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMDEPGWYSFGFEIKDKKCDVPCIGIEMVHDGGKTTWHSAATAIYCLMGSGQLLWDTVTGVDMAL

SEQ ID NO: 30029 - protein, 466 aa, Artificial Sequence
  neuraminidase__InfluenzaB__AHL92325
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMGEPGWYSFGFEIKDKKCDVPCIGIEMVHDGGKTTWHSAATAIYCLMGSGQLLWDTVTGVDMAL

SEQ ID NO: 30030 - protein, 466 aa, Artificial Sequence; identical to SEQ ID NO: 28788
  neuraminidase__InfluenzaB__AHL92336

SEQ ID NO: 30031 - protein, 466 aa, Artificial Sequence
  neuraminidase__InfluenzaB__AHL92358
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYVGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 30032 - protein, 466 aa, Artificial Sequence; identical to SEQ ID NO: 30031
  neuraminidase__InfluenzaB__AHL92369

SEQ ID NO: 30033 - protein, 466 aa, Artificial Sequence
  neuraminidase__InfluenzaB__AHL92380
MLPSTIQTLTLFLTSGGVLLSLYVSASLSYLLYSDILLKFSRTEITAPIMPLDCANASNVQAVNRSATKGVKLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30034 - protein, 466 aa, Artificial Sequence
  neuraminidase__InfluenzaB__AHL92391
MLPSTIQTLTLFLTSGGVLLSLYVSASLSYLLYSDILLKFSRTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRSKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30035 - protein, 466 aa, Artificial Sequence; identical to SEQ ID NO: 28817
  neuraminidase__InfluenzaB__AHL92402

SEQ ID NO: 30036 - protein, 466 aa, Artificial Sequence; identical to SEQ ID NO: 28817
  neuraminidase__InfluenzaB__AHL92413

SEQ ID NO: 30037 - protein, 466 aa, Artificial Sequence; identical to SEQ ID NO: 28817
  neuraminidase__InfluenzaB__AHL92424

SEQ ID NO: 30038 - protein, 466 aa, Artificial Sequence
  neuraminidase__InfluenzaB__AHL92435
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMISMEEPGWYSFGFEIKDKKCDVPCIGIEMVHDGGKTTWHSAATAIYCLMGSGQLLWDTVTGVDMAL

SEQ ID NO: 30039 - protein, 466 aa, Artificial Sequence; identical to SEQ ID NO: 28817
  neuraminidase__InfluenzaB__AHL92446

SEQ ID NO: 30040 - protein, 466 aa, Artificial Sequence; identical to SEQ ID NO: 28817
  neuraminidase__InfluenzaB__AHL92457

SEQ ID NO: 30041 - protein, 466 aa, Artificial Sequence; identical to SEQ ID NO: 28817
  neuraminidase__InfluenzaB__AHL92468

SEQ ID NO: 30042 - protein, 466 aa, Artificial Sequence; identical to SEQ ID NO: 28817
  neuraminidase__InfluenzaB__AHL92479

SEQ ID NO: 30043 - protein, 466 aa, Artificial Sequence; identical to SEQ ID NO: 28788
  neuraminidase__InfluenzaB__AHL92490

SEQ ID NO: 30044 - protein, 466 aa, Artificial Sequence; identical to SEQ ID NO: 28817
  neuraminidase__InfluenzaB__AHL92501

SEQ ID NO: 30045 - protein, 466 aa, Artificial Sequence
  neuraminidase__InfluenzaB__AHL92512
MLPSTIQTLTLFLTSGGVLLSLYVSASLSYLLYSDILLKFSRTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMVAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30046 - protein, 466 aa, Artificial Sequence; identical to SEQ ID NO: 28817
  neuraminidase__InfluenzaB__AHL92523

SEQ ID NO: 30047 - protein, 466 aa, Artificial Sequence; identical to SEQ ID NO: 28817
  neuraminidase__InfluenzaB__AHL92534

SEQ ID NO: 30048 - protein, 466 aa, Artificial Sequence; identical to SEQ ID NO: 28788
  neuraminidase__InfluenzaB__AHL92545

SEQ ID NO: 30049 - protein, 466 aa, Artificial Sequence; identical to SEQ ID NO: 28817
  neuraminidase__InfluenzaB__AHL92556

SEQ ID NO: 30050 - protein, 466 aa, Artificial Sequence; identical to SEQ ID NO: 28817
  neuraminidase__InfluenzaB__AHL92567

SEQ ID NO: 30051 - protein, 466 aa, Artificial Sequence; identical to SEQ ID NO: 28817
  neuraminidase__InfluenzaB__AHL92578

SEQ ID NO: 30052 - protein, 466 aa, Artificial Sequence; identical to SEQ ID NO: 28788
  neuraminidase__InfluenzaB__AHL92589

SEQ ID NO: 30053 - protein, 466 aa, Artificial Sequence; identical to SEQ ID NO: 28817
  neuraminidase__InfluenzaB__AHL92600

SEQ ID NO: 30054 - protein, 466 aa, Artificial Sequence; identical to SEQ ID NO: 29844
  neuraminidase__InfluenzaB__AHL92611

SEQ ID NO: 30055 - protein, 466 aa, Artificial Sequence
  neuraminidase__InfluenzaB__AHL92622
MLPSTIQTLTLFLTSGGVLLSLYVSASLSYLLYSDILLKFSRTEITAPIMPLDCANASNVQAVNRSATKGVTFLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30056 - protein, 466 aa, Artificial Sequence
  neuraminidase__InfluenzaB__AHL92633
MLPSTIQTLTLFLTSGGVLLSLYVSASLSYLLYSDILLKFSRTEITAPIMPLDCANASNVQAVNRSATKGVTFLLPEPEWTYPRLSCPGSTFQKALLISPHRFGETKGNSAPLIIREPFIACGPKECKHFALTHYAAQPGGYYNGTREDRNKLRHLISVKLGKIPIVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30057 - protein, 466 aa, Artificial Sequence; identical to SEQ ID NO: 28788
  neuraminidase__InfluenzaB__AHL92644

SEQ ID NO: 30058 - protein, 466 aa, Artificial Sequence; identical to SEQ ID NO: 28788
  neuraminidase__InfluenzaB__AHL92655

SEQ ID NO: 30059 - protein, 466 aa, Artificial Sequence; identical to SEQ ID NO: 28817
  neuraminidase__InfluenzaB__AHL92666

SEQ ID NO: 30060 - protein, 466 aa, Artificial Sequence; identical to SEQ ID NO: 28817
  neuraminidase__InfluenzaB__AHL92677

SEQ ID NO: 30061 - protein, 466 aa, Artificial Sequence; identical to SEQ ID NO: 28788
  neuraminidase__InfluenzaB__AHL92688

SEQ ID NO: 30062 - protein, 466 aa, Artificial Sequence; identical to SEQ ID NO: 28817
  neuraminidase__InfluenzaB__AHL92699

SEQ ID NO: 30063 - protein, 466 aa, Artificial Sequence; identical to SEQ ID NO: 28817
  neuraminidase__InfluenzaB__AHL92710

SEQ ID NO: 30064 - protein, 466 aa, Artificial Sequence; identical to SEQ ID NO: 28817
  neuraminidase__InfluenzaB__AHL92721

SEQ ID NO: 30065 - protein, 466 aa, Artificial Sequence; identical to SEQ ID NO: 28817
  neuraminidase__InfluenzaB__AHL92732

SEQ ID NO: 30066 - protein, 466 aa, Artificial Sequence; identical to SEQ ID NO: 28817
  neuraminidase__InfluenzaB__AHL92743

SEQ ID NO: 30067 - protein, 466 aa, Artificial Sequence; identical to SEQ ID NO: 28817
  neuraminidase__InfluenzaB__AHL92754

SEQ ID NO: 30068 - protein, 466 aa, Artificial Sequence; identical to SEQ ID NO: 28817
  neuraminidase__InfluenzaB__AHL92765

SEQ ID NO: 30069 - protein, 466 aa, Artificial Sequence; identical to SEQ ID NO: 28817
  neuraminidase__InfluenzaB__AHL92776

SEQ ID NO: 30070 - protein, 466 aa, Artificial Sequence; identical to SEQ ID NO: 28817
  neuraminidase__InfluenzaB__AHL92787

SEQ ID NO: 30071 - protein, 466 aa, Artificial Sequence; identical to SEQ ID NO: 28817
  neuraminidase__InfluenzaB__AHL92798

SEQ ID NO: 30072 - protein, 466 aa, Artificial Sequence
  neuraminidase__InfluenzaB__AHL92809
MLPSTIQTLTLFLTSGGVLLSLYVSASLSYLLYSDILLKFSRTEITAPIMPLDCANASNVQAVNRSAIKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30073 - protein, 466 aa, Artificial Sequence
  neuraminidase__InfluenzaB__AHL92820
MLPSTIQTLTLFLTSGGVLLSLYVSASLSYLLYSDILLKFSRTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKKTWHSAATAIYCLMGSGQLLWDTVTGVNMTL

SEQ ID NO: 30074 - protein, 466 aa, Artificial Sequence
  neuraminidase__InfluenzaB__AHL92842
MLPSTIQTLTLFLTSGGVLLSLYVSASLSYLLYSDILLKFSRTEITAPIMPLDCANASNVQAVNRSTTKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30075 - protein, 466 aa, Artificial Sequence; identical to SEQ ID NO: 28817
  neuraminidase__InfluenzaB__AHL92853

SEQ ID NO: 30076 - protein, 466 aa, Artificial Sequence; identical to SEQ ID NO: 28817
  neuraminidase__InfluenzaB__AHL92864

SEQ ID NO: 30077 - protein, 466 aa, Artificial Sequence; identical to SEQ ID NO: 28670
  neuraminidase__InfluenzaB__AHL92875

SEQ ID NO: 30078 - protein, 466 aa, Artificial Sequence; identical to SEQ ID NO: 28627
  neuraminidase__InfluenzaB__AHL92886

SEQ ID NO: 30079 - protein, 466 aa, Artificial Sequence
  neuraminidase__InfluenzaB__AHL92897
MLPSTIQTLTLFLTSGGVLLSLYVSASLSYLLYSDILLKFSPTEITAPTIPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30080 - protein, 466 aa, Artificial Sequence
  neuraminidase__InfluenzaB__AHL92908
MLPSTIQTLTLFLTLGGVLLSLYVSASLSYLLYSDILLKFSQTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAVYCLMGSGQLLWDTITGVDMAL

SEQ ID NO: 30081 - protein, 466 aa, Artificial Sequence
  neuraminidase__InfluenzaB__AHL92919
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGIDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30082 - protein, 466 aa, Artificial Sequence
  neuraminidase__InfluenzaB__AHL92930
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLDVETDTAEIRLMCTDTYLDTPRPDDGSITGPCESNGDKGSGGIKGGFVHQRMASKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30083 - protein, 466 aa, Artificial Sequence; identical to SEQ ID NO: 28627
  neuraminidase__InfluenzaB__AHL92941

SEQ ID NO: 30084 - protein, 466 aa, Artificial Sequence; identical to SEQ ID NO: 28635
  neuraminidase__InfluenzaB__AHL92952

SEQ ID NO: 30085 - protein, 466 aa, Artificial Sequence; identical to SEQ ID NO: 28635
  neuraminidase__InfluenzaB__AHL92963

SEQ ID NO: 30086 - protein, 466 aa, Artificial Sequence
  neuraminidase__InfluenzaB__AHL92974
MLPSTIQTLTLFLTSGGVLLSLYVSASLSYLLYSDILLKFSPTEITAPTMPLDCANASNVHAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYNGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30087 - protein, 466 aa, Artificial Sequence; identical to SEQ ID NO: 28635
  neuraminidase__InfluenzaB__AHL92985

SEQ ID NO: 30088 - protein, 466 aa, Artificial Sequence; identical to SEQ ID NO: 28635
  neuraminidase__InfluenzaB__AHL92996

SEQ ID NO: 30089 - protein, 466 aa, Artificial Sequence; identical to SEQ ID NO: 30008
  neuraminidase__InfluenzaB__AHL93008

SEQ ID NO: 30090 - protein, 466 aa, Artificial Sequence; identical to SEQ ID NO: 30017
  neuraminidase__InfluenzaB__AHL93019

SEQ ID NO: 30091 - protein, 466 aa, Artificial Sequence; identical to SEQ ID NO: 30017
  neuraminidase__InfluenzaB__AHL93030

SEQ ID NO: 30092 - protein, 466 aa, Artificial Sequence; identical to SEQ ID NO: 30031
  neuraminidase__InfluenzaB__AHL93041

SEQ ID NO: 30093 - protein, 466 aa, Artificial Sequence; identical to SEQ ID NO: 30031
  neuraminidase__InfluenzaB__AHL93052

SEQ ID NO: 30094 - protein, 466 aa, Artificial Sequence; identical to SEQ ID NO: 28817
  neuraminidase__InfluenzaB__AHL93063

SEQ ID NO: 30095 - protein, 466 aa, Artificial Sequence; identical to SEQ ID NO: 28817
  neuraminidase__InfluenzaB__AHL93074

SEQ ID NO: 30096 - protein, 466 aa, Artificial Sequence; identical to SEQ ID NO: 28817
  neuraminidase__InfluenzaB__AHL93085

SEQ ID NO: 30097 - protein, 466 aa, Artificial Sequence; identical to SEQ ID NO: 30074
  neuraminidase__InfluenzaB__AHL93096

SEQ ID NO: 30098 - protein, 466 aa, Artificial Sequence; identical to SEQ ID NO: 28817
  neuraminidase__InfluenzaB__AHL93107

SEQ ID NO: 30099 - protein, 466 aa, Artificial Sequence; identical to SEQ ID NO: 28817
  neuraminidase__InfluenzaB__AHL93118

SEQ ID NO: 30100 - protein, 466 aa, Artificial Sequence; identical to SEQ ID NO: 28788
  neuraminidase__InfluenzaB__AHL93129

SEQ ID NO: 30101 - protein, 466 aa, Artificial Sequence; identical to SEQ ID NO: 28817
  neuraminidase__InfluenzaB__AHL93140

SEQ ID NO: 30102 - protein, 466 aa, Artificial Sequence; identical to SEQ ID NO: 28788
  neuraminidase__InfluenzaB__AHL93151

SEQ ID NO: 30103 - protein, 466 aa, Artificial Sequence; identical to SEQ ID NO: 28817
  neuraminidase__InfluenzaB__AHL93162

SEQ ID NO: 30104 - protein, 466 aa, Artificial Sequence; identical to SEQ ID NO: 28817
  neuraminidase__InfluenzaB__AHL93173

SEQ ID NO: 30105 - protein, 466 aa, Artificial Sequence; identical to SEQ ID NO: 28788
  neuraminidase__InfluenzaB__AHL93184

SEQ ID NO: 30106 - protein, 466 aa, Artificial Sequence; identical to SEQ ID NO: 28817
  neuraminidase__InfluenzaB__AHL93195

SEQ ID NO: 30107 - protein, 466 aa, Artificial Sequence; identical to SEQ ID NO: 28817
  neuraminidase__InfluenzaB__AHL93206

SEQ ID NO: 30108 - protein, 466 aa, Artificial Sequence; identical to SEQ ID NO: 28961
  neuraminidase__InfluenzaB__AHL93217

SEQ ID NO: 30109 - protein, 466 aa, Artificial Sequence; identical to SEQ ID NO: 28961
  neuraminidase__InfluenzaB__AHL93228

SEQ ID NO: 30110 - protein, 466 aa, Artificial Sequence
  neuraminidase__InfluenzaB__AHL93239
MLPSTIQTLTLFLTSGGVLLSLYVSASLSYLLYSDILLKFSPTEITAPTMPLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30111 - protein, 466 aa, Artificial Sequence
  neuraminidase__InfluenzaB__AHL93250
MLPSTIQMLTLFLTSGGVLLSLYVSASLSYLLYSDILLKFSPTEITAPTMPLDCANASNVHAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWTDSDALAFRGVMVSMKEPGWYSFGFEIKDKKCDVPCIGIEMVHDGGKETWHSAATAIYCLMGSGQLLWDTVTGVDMAL

SEQ ID NO: 30112 - protein, 466 aa, Artificial Sequence; identical to SEQ ID NO: 28961
  neuraminidase__InfluenzaB__AHL93261

SEQ ID NO: 30113 - protein, 466 aa, Artificial Sequence; identical to SEQ ID NO: 28961
  neuraminidase__InfluenzaB__AHL93272

SEQ ID NO: 30114 - protein, 466 aa, Artificial Sequence; identical to SEQ ID NO: 28961
  neuraminidase__InfluenzaB__AHL93283

SEQ ID NO: 30115 - protein, 466 aa, Artificial Sequence; identical to SEQ ID NO: 28961
  neuraminidase__InfluenzaB__AHL93294

SEQ ID NO: 30116 - protein, 466 aa, Artificial Sequence
  neuraminidase__InfluenzaB__AHL93305
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFVACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30117 - protein, 466 aa, Artificial Sequence; identical to SEQ ID NO: 28961
  neuraminidase__InfluenzaB__AHL93316

SEQ ID NO: 30118 - protein, 466 aa, Artificial Sequence
  neuraminidase__InfluenzaB__AHL93338
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDAAEIRLMCTDTYLDTPRPNDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30119 - protein, 466 aa, Artificial Sequence
  neuraminidase__InfluenzaB__AHL93349
MLPSTIQTLTLFLTSGGVLLSLYVSASLSYLLYSDILLKFSPTEITAPTMPLDCANASNVQAVNRSATKGVTLLLPEPEWTYPRLSCQGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESNGDKGSGGIKGGFVHQRMESKIGRWYSRTMSKTERMGMELYVKYDGDPWADSDALAFSGVMVSMKEPGWYSFGFEIKDKKCDVPCIGIEMVHDGGKETWHSAATAIYCLMGSGQLLWDTVTGVNMAL

SEQ ID NO: 30120 - protein, 466 aa, Artificial Sequence; identical to SEQ ID NO: 28961
  neuraminidase__InfluenzaB__AHL93371

SEQ ID NO: 30121 - protein, 466 aa, Artificial Sequence
  neuraminidase__InfluenzaB__AHL93382
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESNGDKGSGGIKGGFVHQRMESKIGRWYSRTMSKTERMGMELYVKYDGDPWADSDALAFSGVMVSMKEPGWYSFGFEIKDKKCDVPCIGIEMVHDGGKETWHSAATAIYCLMGSGQLLWDTVTGVNMAL

SEQ ID NO: 30122 - protein, 466 aa, Artificial Sequence; identical to SEQ ID NO: 28961
  neuraminidase__InfluenzaB__AHL93393

SEQ ID NO: 30123 - protein, 466 aa, Artificial Sequence; identical to SEQ ID NO: 28961
  neuraminidase__InfluenzaB__AHL93404

SEQ ID NO: 30124 - protein, 466 aa, Artificial Sequence; identical to SEQ ID NO: 28961
  neuraminidase__InfluenzaB__AHL93415

SEQ ID NO: 30125 - protein, 466 aa, Artificial Sequence; identical to SEQ ID NO: 28961
  neuraminidase__InfluenzaB__AHL93426

SEQ ID NO: 30126 - protein, 466 aa, Artificial Sequence; identical to SEQ ID NO: 28961
  neuraminidase__InfluenzaB__AHL93437

SEQ ID NO: 30127 - protein, 466 aa, Artificial Sequence; identical to SEQ ID NO: 30121
  neuraminidase__InfluenzaB__AHL93448

SEQ ID NO: 30128 - protein, 467 aa, Artificial Sequence
  neuraminidase__InfluenzaB__AHL93459
MLPSTIQTLTLFLTSGGVLLSLYVSASLSYLLYSDILLKFSPTEITAPTMPLDCANASNVQAVNRSATKGVTLLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30129 - protein, 466 aa, Artificial Sequence
  neuraminidase__InfluenzaB__AHL93470
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESNGDKGSGGIKGGFVHQRMESKIGRWYSRTMSKTERMGMGLYVKYDGDPWADSDALTFSGVMVSMKEPGWYSFGFEIKDKKCDVPCIGIEMVHDGGKETWHSAATAIYCLMGSGQLLWDTVTGVDMAL

SEQ ID NO: 30130 - protein, 466 aa, Artificial Sequence; identical to SEQ ID NO: 28898
  neuraminidase__InfluenzaB__AHL93481

SEQ ID NO: 30131 - protein, 466 aa, Artificial Sequence; identical to SEQ ID NO: 28956
  neuraminidase__InfluenzaB__AHL93492

SEQ ID NO: 30132 - protein, 466 aa, Artificial Sequence; identical to SEQ ID NO: 28817
  neuraminidase__InfluenzaB__AHL93503

SEQ ID NO: 30133 - protein, 466 aa, Artificial Sequence
  neuraminidase__InfluenzaB__AHL93514
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISIKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGSCESNGDKGSGGIKGGFVHQRMESKIGRWYSRTMSKTERMGMGLYVKYDGDPWADSDALTFSGVMVSMKEPGWYSFGFEIKDKKCDVPCIGIEMVHDGGKETWHSAATAIYCLMGSGQLLWDTVTGVDMAL

SEQ ID NO: 30134 - protein, 466 aa, Artificial Sequence; identical to SEQ ID NO: 28817
  neuraminidase__InfluenzaB__AHL93525

SEQ ID NO: 30135 - protein, 466 aa, Artificial Sequence; identical to SEQ ID NO: 28956
  neuraminidase__InfluenzaB__AHL93536

SEQ ID NO: 30136 - protein, 466 aa, Artificial Sequence
  neuraminidase__InfluenzaB__AHL93558
MLPSTIQTLTLFLTSGGVLLSLYVSASLSYLLYSDILLKFSPTEITAPAMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFIHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30137 - protein, 466 aa, Artificial Sequence
  neuraminidase__InfluenzaB__AHL93569
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRMESKIGRWYSRTMSKTERMGMGLYVKYDGDPWADSDALTFSGVMVSMKEPGWYSFGFEIKDKKCDVPCIGIEMVHDGGKETWHSAATAIYCLMGSGQLLWDTVTGVDMAL

SEQ ID NO: 30138 - protein, 466 aa, Artificial Sequence; identical to SEQ ID NO: 28956
  neuraminidase__InfluenzaB__AHL93580

SEQ ID NO: 30139 - protein, 466 aa, Artificial Sequence; identical to SEQ ID NO: 28956
  neuraminidase__InfluenzaB__AHL93591

SEQ ID NO: 30140 - protein, 466 aa, Artificial Sequence
  neuraminidase__InfluenzaB__AHL93613
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMVTDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALVFSGVMVSMKEPGWYSFGFEIKDKKCDVPCIGIEMVHDGGKETWHSAATAIYCLMGSGQLLWDTVTGVDMAL

SEQ ID NO: 30141 - protein, 466 aa, Artificial Sequence; identical to SEQ ID NO: 28956
  neuraminidase__InfluenzaB__AHL93624

SEQ ID NO: 30142 - protein, 466 aa, Artificial Sequence; identical to SEQ ID NO: 30140
  neuraminidase__InfluenzaB__AHL93635

SEQ ID NO: 30143 - protein, 466 aa, Artificial Sequence; identical to SEQ ID NO: 30140
  neuraminidase__InfluenzaB__AHL93646

SEQ ID NO: 30144 - protein, 466 aa, Artificial Sequence; identical to SEQ ID NO: 28817
  neuraminidase__InfluenzaB__AHL93657

SEQ ID NO: 30145 - protein, 466 aa, Artificial Sequence; identical to SEQ ID NO: 28956
  neuraminidase__InfluenzaB__AHL93668

SEQ ID NO: 30146 - protein, 466 aa, Artificial Sequence
  neuraminidase__InfluenzaB__AHL93679
MLPSTIQTLTLFLTSGGVLLSLYVSALLSYLLYSDILLKFSPTEITAPTMSLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEILPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30147 - protein, 466 aa, Artificial Sequence; identical to SEQ ID NO: 30140
  neuraminidase__InfluenzaB__AHL93690

SEQ ID NO: 30148 - protein, 466 aa, Artificial Sequence; identical to SEQ ID NO: 30140
  neuraminidase__InfluenzaB__AHL93701

SEQ ID NO: 30149 - protein, 466 aa, Artificial Sequence; identical to SEQ ID NO: 30140
  neuraminidase__InfluenzaB__AHL93712

SEQ ID NO: 30150 - protein, 466 aa, Artificial Sequence
  neuraminidase__InfluenzaB__AHL93723
MLPSTIQMLTLFLTSGGVLLSLYVSASLSYLLYSDILLKFSPTEITAPTMPLDCANASNVHAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSTTGPCESNGDKGSGGIKGGFVHQRMASKIGRWYSRTMSKTERKGMGLYVKYDGDPWTDSDALAFRGVMVSMKEPGWYSFGFEIKDKKCDVPCIGIEMVHDGGKETWHSAATAIYCLMGSGQLLWDTVTGVDMAL

SEQ ID NO: 30151 - protein, 466 aa, Artificial Sequence; identical to SEQ ID NO: 28956
  neuraminidase__InfluenzaB__AHL93734

SEQ ID NO: 30152 - protein, 466 aa, Artificial Sequence
  neuraminidase__InfluenzaB__AHL93745
MLPSTIQMLTLFLTSGGVLLSLYVSASLSYLLYSDILLKFSPTEITAPTMPLDCANASNVHAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNVLRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERKGMGLYVKYDGDPWTDSDALAFRGVMVSMKEPGWYSFGFEIKDKKCDVPCIGIEMVHDGGKETWHSAATAIYCLMGSGQLLWDTVTGVDMAL

SEQ ID NO: 30153 - protein, 466 aa, Artificial Sequence; identical to SEQ ID NO: 29119
  neuraminidase__InfluenzaB__AHL93756

SEQ ID NO: 30154 - protein, 466 aa, Artificial Sequence; identical to SEQ ID NO: 30140
  neuraminidase__InfluenzaB__AHL93767

SEQ ID NO: 30155 - protein, 466 aa, Artificial Sequence
  neuraminidase__InfluenzaB__AHL93778
MLPSTIQTLILFLTSGGVLLSLYVSALLSYLLYSDILLKFSPTEITAPTMSLDCANASNVQAVNRSATKGVTFLLPEPEWTYPRLSCPGSIFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30156 - protein, 466 aa, Artificial Sequence
  neuraminidase__InfluenzaB__AHL93789
MLPSTIQTLTLFLTSGGVLLSLYVSASLSYLLYSDILLKFSPTGITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMVTDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALVFSGVMVSMKEPGWYSFGFEIKDKKCDVPCIGIEMVHDGGKETWHSAATAIYCLMGSGQLLWDTVTGVDMAL

SEQ ID NO: 30157 - protein, 466 aa, Artificial Sequence; identical to SEQ ID NO: 28956
  neuraminidase__InfluenzaB__AHL93800

SEQ ID NO: 30158 - protein, 466 aa, Artificial Sequence; identical to SEQ ID NO: 28956
  neuraminidase__InfluenzaB__AHL93811

SEQ ID NO: 30159 - protein, 466 aa, Artificial Sequence; identical to SEQ ID NO: 29492
  neuraminidase__InfluenzaB__AHL93822

SEQ ID NO: 30160 - protein, 466 aa, Artificial Sequence; identical to SEQ ID NO: 28956
  neuraminidase__InfluenzaB__AHL93833

SEQ ID NO: 30161 - protein, 466 aa, Artificial Sequence
  neuraminidase__InfluenzaB__AHL93844
MLPSTIQTLTLFLTSGGVLLSLYVSASLSYLLYSGILLKFSPTEITAPTMPLDCANASNVQAVNRSATKEVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDDNALLKVKYGEAYTDTYHSYAHKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30162 - protein, 466 aa, Artificial Sequence; identical to SEQ ID NO: 28956
  neuraminidase__InfluenzaB__AHL93855

SEQ ID NO: 30163 - protein, 466 aa, Artificial Sequence; identical to SEQ ID NO: 28956
  neuraminidase__InfluenzaB__AHL93866

SEQ ID NO: 30164 - protein, 466 aa, Artificial Sequence; identical to SEQ ID NO: 28956
  neuraminidase__InfluenzaB__AHL93877

SEQ ID NO: 30165 - protein, 466 aa, Artificial Sequence; identical to SEQ ID NO: 28956
  neuraminidase__InfluenzaB__AHL93888

SEQ ID NO: 30166 - protein, 466 aa, Artificial Sequence
  neuraminidase__InfluenzaB__AHL93899
MLPSTIQMLTLFLTSGGVLLSLYVSASLSYLLYSDILLKFSPTEITAPTMPLDCANASNVHAVNRSATKGVTFLLPEPEWTYPRLSCPGSTFQKALLISPHRFGETKGNSAPLIIREPFIACEPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSTTGPCESNGDKGSGGIKGGFVHQRMASKIGRWYSRTMSKTERKGMGLYVKYDGDPWTDSDALAFRGVMVSMKEPGWYSFGFEIKDKKCDVPCIGIEMVHDGGKETWHSAATAIYCLMGSGQLLWDTVTGVDMAL

SEQ ID NO: 30167 - protein, 466 aa, Artificial Sequence
  neuraminidase__InfluenzaB__AHL93910
MLPSTIQMLTLFLTSGGVLLSLYVSASLSYLLYSDILLKFSPTEITAPTMPLDCANASNVHAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECTCRDNSYTAKRPFVKLNVETDTAEIRLMCTDTYLDTPRPDDGGITGPCESNGDKGSGGIKGGFVHQRMASKIGRWYSRTMSKTERKGMGLYVKYDGDPWTDSDALAFRGVMVSMKEPGWYSFGFEIKDKKCDVPCIGIEMVHDGGKETWHSAATAIYCLMGSGQLLWDTVTGVDMAL

SEQ ID NO: 30168 - protein, 466 aa, Artificial Sequence; identical to SEQ ID NO: 28956
  neuraminidase__InfluenzaB__AHL93921

SEQ ID NO: 30169 - protein, 466 aa, Artificial Sequence
  neuraminidase__InfluenzaB__AHL93932
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMVTDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMELYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30170 - protein, 466 aa, Artificial Sequence; identical to SEQ ID NO: 29119
  neuraminidase__InfluenzaB__AHL93943

SEQ ID NO: 30171 - protein, 466 aa, Artificial Sequence; identical to SEQ ID NO: 28956
  neuraminidase__InfluenzaB__AHL93954

SEQ ID NO: 30172 - protein, 466 aa, Artificial Sequence
  neuraminidase__InfluenzaB__AHL93965
MLPSTIQTLTLFLTSGGVLLSLYVSASLSYLLYSDILLKFSPTEITAPAMPLDCANASNVQAVNCSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGNGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30173 - protein, 466 aa, Artificial Sequence; identical to SEQ ID NO: 28875
  neuraminidase__InfluenzaB__AHL93976

SEQ ID NO: 30174 - protein, 466 aa, Artificial Sequence; identical to SEQ ID NO: 30146
  neuraminidase__InfluenzaB__AHL93987

SEQ ID NO: 30175 - protein, 466 aa, Artificial Sequence
  neuraminidase__InfluenzaB__AHL93998
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGEIKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGVSECRFLKIREGRIIKEIFPTGRVKHTEECTCGFASNKTIECACRDNRYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 30176 - protein, 466 aa, Artificial Sequence
  neuraminidase__InfluenzaB__AHL94009
MLPSTIQMLTLFLTSGGVLLSLYVSASLSYLLYSDILLKFSPTEITAPTMPLDCANASNVHAVNRSATKGVTFLLPEPKWTYPRLSCPGSTFQKALLISPHRFGETKGNSAPLIIREPFIACGPNECRHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERKGMGLYVKYDGDPWTDSDALAFRGVMVSMKEPGWYSFGFEIKDKKCDVPCIGIEMVHDGGKETWHSAATAIYCLMGSGQLLWDTVTGVDMAL

SEQ ID NO: 30177 - protein, 466 aa, Artificial Sequence; identical to SEQ ID NO: 28956
  neuraminidase__InfluenzaB__AHL94020

SEQ ID NO: 30178 - protein, 466 aa, Artificial Sequence; identical to SEQ ID NO: 28956
  neuraminidase__InfluenzaB__AHL94031

SEQ ID NO: 30179 - protein, 466 aa, Artificial Sequence; identical to SEQ ID NO: 29119
  neuraminidase__InfluenzaB__AHL94042

SEQ ID NO: 30180 - protein, 466 aa, Artificial Sequence
  neuraminidase__InfluenzaB__AHL94053
MLPSTIQTLTLFLTSGGVLLSLYLSALLSYLLYSDILLKFSPTEITAPTMSLDCANASNVQAVNRSATKGVTFLLPEPEWTYPRLSCPGSTFQRALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30181 - protein, 466 aa, Artificial Sequence; identical to SEQ ID NO: 28956
  neuraminidase__InfluenzaB__AHL94064

SEQ ID NO: 30182 - protein, 466 aa, Artificial Sequence; identical to SEQ ID NO: 28956
  neuraminidase__InfluenzaB__AHL94075

SEQ ID NO: 30183 - protein, 466 aa, Artificial Sequence
  neuraminidase__InfluenzaB__AHL94086
MLPSTIQTLTLFLTSGGVLLSLYVSASLSYLLYSDILLKFSRTEITAPIMPLDCANASNVQAVNRSATKGVTFLLPEPEWTYPRLSCPGSTFQKALLISPHRFGETKGNSAPLIIREPFVACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30184 - protein, 466 aa, Artificial Sequence; identical to SEQ ID NO: 29119
  neuraminidase__InfluenzaB__AHL94095

SEQ ID NO: 30185 - protein, 466 aa, Artificial Sequence; identical to SEQ ID NO: 28956
  neuraminidase__InfluenzaB__AHL94106

SEQ ID NO: 30186 - protein, 466 aa, Artificial Sequence
  neuraminidase__InfluenzaB__AHL94117
MLPSTIQMLTLFLTSGGVLLSLYVSASLSYLLYSDILLKFSPTEITAPTMPLDCANASNVHAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERKGMGLHVKYDGDPWTDSDALAFRGVMVSMKEPGWYSFGFEIKDKKCDVPCIGIEMVHDGGKETWHSAATAIYCLMGSGQLLWDTVTGVNMAL

SEQ ID NO: 30187 - protein, 466 aa, Artificial Sequence; identical to SEQ ID NO: 28956
  neuraminidase__InfluenzaB__AHL94128

SEQ ID NO: 30188 - protein, 466 aa, Artificial Sequence
  neuraminidase__InfluenzaB__AHL94139
MLPSTIQTLTLFLTSGGVLLSLYVSALLSYLLYSDILLKFSPTEITAPTMSLDCANASNVQAVNRSATKGVTFLLPEPEWTYPRLSCPGSTFQRALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIKLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30189 - protein, 466 aa, Artificial Sequence; identical to SEQ ID NO: 30146
  neuraminidase__InfluenzaB__AHL94150

SEQ ID NO: 30190 - protein, 466 aa, Artificial Sequence
  neuraminidase__InfluenzaB__AHL94161
MLPSTIQMLTLFLTSGGVLLSLYVSASLSYLLYSDILLKFSPTEITAPTMPLDCANASNVHAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAKIRLMCTDTYLDTPRPDDGSITGPCESNGDKGSGGIKGGFVHQRMASKIGRWYSRTMSKTERKGMGLYVKYDGDPWTDSDALAFRGVMVSMKEPGWYSFGFEIKDKKCDVPCIGIEMVHDGGKETWHSAATAIYCLMGSGQLLWDTVTGVDMAL

SEQ ID NO: 30191 - protein, 466 aa, Artificial Sequence; identical to SEQ ID NO: 30146
  neuraminidase__InfluenzaB__AHL94183

SEQ ID NO: 30192 - protein, 467 aa, Artificial Sequence
  neuraminidase__InfluenzaB__AHL94194
MLPSTIQTLTLFLTSGGVLLSLYVSALLSYLLYSDILLKFSPTEITAPTMSLDCANASNVQAVNRSATKGVTFLLLPEPEWTYPRLSCPGSTFQRALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNDALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30193 - protein, 466 aa, Artificial Sequence; identical to SEQ ID NO: 28956
  neuraminidase__InfluenzaB__AHL94205

SEQ ID NO: 30194 - protein, 466 aa, Artificial Sequence; identical to SEQ ID NO: 29119
  neuraminidase__InfluenzaB__AHL94214

SEQ ID NO: 30195 - protein, 466 aa, Artificial Sequence
  neuraminidase__InfluenzaB__AHL94224
MLPSTIQMLTLFLTSGGVLLSLYVSASLSYLLYSDILLKFSPTEITAPTMPLDCANASNVHAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERKGMGLYVKYDGDPWIDSDALAFRGVMVSMKEPGWYSFGFEIKDKKCDVPCIGIEMVHDGGKETWHSAATAIYCLMGSGQLLWDTVTGVDMAL

SEQ ID NO: 30196 - protein, 466 aa, Artificial Sequence; identical to SEQ ID NO: 28956
  neuraminidase__InfluenzaB__AHL94235

SEQ ID NO: 30197 - protein, 466 aa, Artificial Sequence; identical to SEQ ID NO: 29119
  neuraminidase__InfluenzaB__AHL94246

SEQ ID NO: 30198 - protein, 466 aa, Artificial Sequence; identical to SEQ ID NO: 29119
  neuraminidase__InfluenzaB__AHL94257

SEQ ID NO: 30199 - protein, 466 aa, Artificial Sequence; identical to SEQ ID NO: 28817
  neuraminidase__InfluenzaB__AHL94267

SEQ ID NO: 30200 - protein, 466 aa, Artificial Sequence; identical to SEQ ID NO: 28817
  neuraminidase__InfluenzaB__AHL94278

SEQ ID NO: 30201 - protein, 466 aa, Artificial Sequence; identical to SEQ ID NO: 28817
  neuraminidase__InfluenzaB__AHL94299

SEQ ID NO: 30202 - protein, 466 aa, Artificial Sequence
  neuraminidase__InfluenzaB__AHL94310
MLPSTIQTLTLFLTSGGVLLSLYVSASLSYLLYSDILLKFSRTEITAPIMPLDCANASNVQAVNRSATKGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGSASGISECRFLKIREGRIIKEIFPTGRVKHTEECTCGFASNKTIECACRDNSYTAKRPFVKLNVETDTAEIRLMCTETYLDTPRPNDGSIAGPCESNGDEGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30203 - protein, 466 aa, Artificial Sequence; identical to SEQ ID NO: 30202
  neuraminidase__InfluenzaB__AHL94321

SEQ ID NO: 30204 - protein, 466 aa, Artificial Sequence
  neuraminidase__InfluenzaB__AHL94332
MLPSTIQTLTLFLTSGGVLLSLYVSASLSYLLYSDILLKFSRTEITAPIMPLDCANASNVQAVNRSATKGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDEGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30205 - protein, 466 aa, Artificial Sequence; identical to SEQ ID NO: 28817
  neuraminidase__InfluenzaB__AHL94343

SEQ ID NO: 30206 - protein, 466 aa, Artificial Sequence
  neuraminidase__InfluenzaB__AHL94354
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30207 - protein, 466 aa, Artificial Sequence; identical to SEQ ID NO: 30206
  neuraminidase__InfluenzaB__AHL94365

SEQ ID NO: 30208 - protein, 466 aa, Artificial Sequence
  neuraminidase__InfluenzaB__AHL94387
MLPSTIQTLTLFLTSGGVLLSLYVSASLSYLLYSDILLKFSPTEITAPTMPLDCANASTVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYLGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEIKDKKCDVPCIGIEMVHDGGKEIWHSAATAIYCLMGSGQLLWDTVTGVDMAL

SEQ ID NO: 30209 - protein, 467 aa, Artificial Sequence
  neuraminidase__InfluenzaB__AHL94398
MLPSTIQTLTLFLTSGGVLLSLYVSASLSYLLYSDILLKFSPTEITAPTMPLDCANASNVQAVNRSATKGVTLLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30210 - protein, 466 aa, Artificial Sequence; identical to SEQ ID NO: 30206
  neuraminidase__InfluenzaB__AHL94409

SEQ ID NO: 30211 - protein, 466 aa, Artificial Sequence
  neuraminidase__InfluenzaB__AHL94431
MLPSTIQTLTLFLTSGGVLLSLYVSASLSYLLYSDILLKFSQTEITAPIMPLDCANASNVQAVNHSAAKGVTLILPEPEWTYPRLSCPGSTFQKALLISPHRFGEIKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGVSECRFLKIREGRIIKEIFPTGRVKHTEECTCGFASNKTIECACRDNRYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMISMEEPGWYSFGFEIKDKKCDVPCIGIEMVHDGGKTTWHSAATAIYCLMGSGQLLWDTVTGVDMAL

SEQ ID NO: 30212 - protein, 466 aa, Artificial Sequence
  neuraminidase__InfluenzaB__AHL94442
MLPSTIQTLTLFLTSGGVLLSLYMSASLSYLLYSDILLKFSRTEITAPIMPLDCANASNVQAVNRSATKGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGSASGISECRFLKIREGRIIKEIFPTGRVKHTEECTCGFASNKTIECACRDNSYTAKRPFVKLNVETDTAEIRLMCTETYLDTPRPNDGSIAGPCESNGDEGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30213 - protein, 466 aa, Artificial Sequence; identical to SEQ ID NO: 30202
  neuraminidase__InfluenzaB__AHL94464

SEQ ID NO: 30214 - protein, 466 aa, Artificial Sequence; identical to SEQ ID NO: 28817
  neuraminidase__InfluenzaB__AHL94475

SEQ ID NO: 30215 - protein, 466 aa, Artificial Sequence; identical to SEQ ID NO: 30206
  neuraminidase__InfluenzaB__AHL94486

SEQ ID NO: 30216 - protein, 466 aa, Artificial Sequence; identical to SEQ ID NO: 28817
  neuraminidase__InfluenzaB__AHL94497

SEQ ID NO: 30217 - protein, 466 aa, Artificial Sequence; identical to SEQ ID NO: 30202
  neuraminidase__InfluenzaB__AHL94508

SEQ ID NO: 30218 - protein, 466 aa, Artificial Sequence
  neuraminidase__InfluenzaB__AHL94519
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRMESKIGRWYSRTMSKTERMGMGLYVKYDGDPWTDSDALAFSGVMVSMKEPGWYSFGFEIKDKKCDVPCIGIEMVHDGGKETWHSAATAIYCLMGSGQLLWDTVTGVDMAL

SEQ ID NO: 30219 - protein, 466 aa, Artificial Sequence; identical to SEQ ID NO: 30202
  neuraminidase__InfluenzaB__AHL94530

SEQ ID NO: 30220 - protein, 466 aa, Artificial Sequence; identical to SEQ ID NO: 30206
  neuraminidase__InfluenzaB__AHL94541

SEQ ID NO: 30221 - protein, 466 aa, Artificial Sequence
  neuraminidase__InfluenzaB__AHL94563
MLPSTIQTLTLFLTLGGVLLSLYVSASLSYLLYSDILLKFSRTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30222 - protein, 466 aa, Artificial Sequence; identical to SEQ ID NO: 30175
  neuraminidase__InfluenzaB__AHL94574

SEQ ID NO: 30223 - protein, 466 aa, Artificial Sequence
  neuraminidase__InfluenzaB__AHL94585
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGEIKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGVSECRFLKIREGRIIKEIFPKGRVKHTEECTCGFASNKTIECACRDNRYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 30224 - protein, 466 aa, Artificial Sequence; identical to SEQ ID NO: 30175
  neuraminidase__InfluenzaB__AHL94596

SEQ ID NO: 30225 - protein, 466 aa, Artificial Sequence
  neuraminidase__InfluenzaB__AHL94607
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRLKSKIGRWYSRTMSKTERMGMGLYVKYDGDPWADSDALTFSGVMVSMKEPGWYSFGFEIKDKKCDVPCIGIEMVHDGGKETWHSAATAIYCLMGSGQLLWDTVTGVDMAL

SEQ ID NO: 30226 - protein, 466 aa, Artificial Sequence; identical to SEQ ID NO: 30206
  neuraminidase__InfluenzaB__AHL94618

SEQ ID NO: 30227 - protein, 466 aa, Artificial Sequence; identical to SEQ ID NO: 30202
  neuraminidase__InfluenzaB__AHL94628

SEQ ID NO: 30228 - protein, 466 aa, Artificial Sequence; identical to SEQ ID NO: 30206
  neuraminidase__InfluenzaB__AHL94639

SEQ ID NO: 30229 - protein, 466 aa, Artificial Sequence
  neuraminidase__InfluenzaB__AHL94650
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIREIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30230 - protein, 466 aa, Artificial Sequence
  neuraminidase__InfluenzaB__AHL94661
MLPSTIQTLTLFLTSGGVLLSLYVSASLSYLLYSDILLKFPSTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIQHTEECTCGFASNKTIECACRDNSYTAKRPFVKLNVETDTAEIRLMCTKTYLDTPRPEDGSITGPCESNGGKGSGGIKGGFVHQRMASKIGRWYSRTMSKTERKGMGLYVKYNGDPWADSDALVFSGVMVSMEEPGWYSFGFEIKDKKCDVPCIGIEMVHDGGKETWHSAATAIYCLMGSGQLLWDTVTGVNMTL

SEQ ID NO: 30231 - protein, 466 aa, Artificial Sequence
  neuraminidase__InfluenzaB__AHL94672
MLPSTIQTLTLFLTSGGVLLSLYVSASLSYLLYSDILLKFSRTEITAPIMPLDCANASNVQAVNRSATKGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGSASGISECRFLKIREGRIIKEIFPTGRVKHTEECTCGFASNKTIECACRDNSYTAKRPFVKLNVETDTAEIRLMCTETYLDTPRPNDGSISGPCESNGDEGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30232 - protein, 466 aa, Artificial Sequence
  neuraminidase__InfluenzaB__AHL94683
MLPSTIQTLTLFLTSGGVLLSLYVSASLSYLLYSDILLKFSRTEITAPIMPLDCANASNVQAVNRSATKGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGSASGISECRFLKIREGRIIKEIFPTGRVKHTEECTCGFASNKTIECACRDNSYTAKRPFVKLNVETDTAEIRLMCTETYLDTPRPNDGSITGPCESNGGEGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30233 - protein, 466 aa, Artificial Sequence
  neuraminidase__InfluenzaB__AHL94694
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALTFSGVMVSMKEPGWYSFGFEIKDKKCDVPCIGIEMVHDGGKETWHSAATAIYCLMGSGQLLWDTVTGVDMAL

SEQ ID NO: 30234 - protein, 466 aa, Artificial Sequence; identical to SEQ ID NO: 30206
  neuraminidase__InfluenzaB__AHL94705

SEQ ID NO: 30235 - protein, 466 aa, Artificial Sequence; identical to SEQ ID NO: 28817
  neuraminidase__InfluenzaB__AHL94716

SEQ ID NO: 30236 - protein, 466 aa, Artificial Sequence
  neuraminidase__InfluenzaB__AHL94727
MLPSTIQTLTLFLTSGGVLLSLYVSASLSYLLYSDILLKFPSTEITAPTMPLDCANTSNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIQHTEECTCGFASNKTIECACRDNSYTAKRPFVKLNVETDTAEIRLMCTKTYLDTPRPEDGSITGPCESNGGKGSGGIKGGFVHQRMASKIGRWYSRTMSKTERKGMGLYVKYNGDPWADSDALVFSGVMVSMEEPGWYSFGFEIKDKKCDVPCIGIEMVHDGGKETWHSAATAIYCLMGSGQLLWDTVTGVNMTL

SEQ ID NO: 30237 - protein, 466 aa, Artificial Sequence; identical to SEQ ID NO: 28817
  neuraminidase__InfluenzaB__AHL94738

SEQ ID NO: 30238 - protein, 466 aa, Artificial Sequence
  neuraminidase__InfluenzaB__AHL94749
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEIKDKKCDVPCIGVEMVHDGGKETWHSAATAIYCLMGSGQLLWDTVTGVDMAL

SEQ ID NO: 30239 - protein, 466 aa, Artificial Sequence
  neuraminidase__InfluenzaB__AHL94760
MLPSTIQTLTLFLTSGGVLLSLYVSASLSYLLYSDILLKFSQTEITAPIMPLDCANASNVQAVNHSAAKGVTLLLPEPEWTYPRLSCPGSTFQKALLISPHRFGEIKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGVSECRFLKIREGRIIKEIFPTGRVKHTEECTCGFASNKTIECACRDNRYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDIPCIGIEMVHDGGKTTWHSAATAIYCLMGSGQLLWDTVTGVDMAL

SEQ ID NO: 30240 - protein, 466 aa, Artificial Sequence; identical to SEQ ID NO: 30206
  neuraminidase__InfluenzaB__AHL94770

SEQ ID NO: 30241 - protein, 466 aa, Artificial Sequence; identical to SEQ ID NO: 30204
  neuraminidase__InfluenzaB__AHL94781

SEQ ID NO: 30242 - protein, 466 aa, Artificial Sequence; identical to SEQ ID NO: 30202
  neuraminidase__InfluenzaB__AHL94791

SEQ ID NO: 30243 - protein, 466 aa, Artificial Sequence; identical to SEQ ID NO: 30233
  neuraminidase__InfluenzaB__AHL94801

SEQ ID NO: 30244 - protein, 466 aa, Artificial Sequence; identical to SEQ ID NO: 30202
  neuraminidase__InfluenzaB__AHL94812

SEQ ID NO: 30245 - protein, 466 aa, Artificial Sequence; identical to SEQ ID NO: 30202
  neuraminidase__InfluenzaB__AHL94821

SEQ ID NO: 30246 - protein, 466 aa, Artificial Sequence; identical to SEQ ID NO: 30206
  neuraminidase__InfluenzaB__AHL94831

SEQ ID NO: 30247 - protein, 466 aa, Artificial Sequence
  neuraminidase__InfluenzaB__AHL94840
MLPSTIQTLTLFLTSGGVLLSLYVSASLSYLLYSGILLKFSRTEITAPIMPLDCANASNVQAVNRSATKGVTLLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30248 - protein, 466 aa, Artificial Sequence
  neuraminidase__InfluenzaB__AHL94851
MLPSTIQTLTLFLTSGGVLLSLYVSASLSYLLYSDILLKFSQTEITAPIMPLDCTNASNVQAVNRSAAKGVTLLLPEPEWTYPRLSCPGSTFQKALLISPHRFGEIKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGVSECRFLKIREGRIIKEIFPTGRVKHTEECTCGFASNKTIECACRDNRYTAKRPFVKLNVETDTAEIRLMCTETYLDTPRPNDGSITGPCESDGDKGSGGIKGGFVHQRMTSKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 30249 - protein, 466 aa, Artificial Sequence; identical to SEQ ID NO: 28635
  neuraminidase__InfluenzaB__AHL94862

SEQ ID NO: 30250 - protein, 466 aa, Artificial Sequence; identical to SEQ ID NO: 28817
  neuraminidase__InfluenzaB__AHL94873

SEQ ID NO: 30251 - protein, 466 aa, Artificial Sequence; identical to SEQ ID NO: 30121
  neuraminidase__InfluenzaB__AHL94884

SEQ ID NO: 30252 - protein, 466 aa, Artificial Sequence; identical to SEQ ID NO: 28961
  neuraminidase__InfluenzaB__AHL94893

SEQ ID NO: 30253 - protein, 466 aa, Artificial Sequence; identical to SEQ ID NO: 28961
  neuraminidase__InfluenzaB__AHL94904

SEQ ID NO: 30254 - protein, 466 aa, Artificial Sequence
  neuraminidase__InfluenzaB__AHL94915
MLPSTIQTLTLFLTSGGVLLSLYVSASLSYLLYSDILLKFSPTEITAPTMPLDCANASNVQVVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30255 - protein, 466 aa, Artificial Sequence; identical to SEQ ID NO: 30121
  neuraminidase__InfluenzaB__AHL94926

SEQ ID NO: 30256 - protein, 466 aa, Artificial Sequence
  neuraminidase__InfluenzaB__AHL94937
MLPSTIQTLTLFLTSGGVLLSLYVSASLSYLLYSDILLKFSPTEITAPTLPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30257 - protein, 466 aa, Artificial Sequence; identical to SEQ ID NO: 30140
  neuraminidase__InfluenzaB__AHL94948

SEQ ID NO: 30258 - protein, 466 aa, Artificial Sequence; identical to SEQ ID NO: 28956
  neuraminidase__InfluenzaB__AHL94959

SEQ ID NO: 30259 - protein, 466 aa, Artificial Sequence; identical to SEQ ID NO: 28956
  neuraminidase__InfluenzaB__AHL94969

SEQ ID NO: 30260 - protein, 466 aa, Artificial Sequence; identical to SEQ ID NO: 28956
  neuraminidase__InfluenzaB__AHL94978

SEQ ID NO: 30261 - protein, 466 aa, Artificial Sequence
  neuraminidase__InfluenzaB__AHM00990
MLPSTIQTLTLFLTSGGVLLSLYVSASLSYLLYSDILLKFSQTEITAPIMPLDCTNASNVQAVNHSAAKGVTLLLPEPEWTYPRLSCPGSTFQKALLISPHRFGEIKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGVSECRFLKIREGRIIKEIFPTGRVKHTEECTCGFASNKTIECACRDNRYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 30262 - protein, 466 aa, Artificial Sequence; identical to SEQ ID NO: 30206
  neuraminidase__InfluenzaB__AHM01001

SEQ ID NO: 30263 - protein, 466 aa, Artificial Sequence
  neuraminidase__InfluenzaB__AHM01012
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWTDSDALAFSGVMVSMKEPGWYSFGFEIKDKKCDVPCIGIEMVHDGGKETWHSAATAIYCLMGSGQLLWDTVTGVDMAL

SEQ ID NO: 30264 - protein, 466 aa, Artificial Sequence; identical to SEQ ID NO: 30206
  neuraminidase__InfluenzaB__AHM01023

SEQ ID NO: 30265 - protein, 466 aa, Artificial Sequence; identical to SEQ ID NO: 30206
  neuraminidase__InfluenzaB__AHM01034

SEQ ID NO: 30266 - protein, 466 aa, Artificial Sequence
  neuraminidase__InfluenzaB__AHM01045
MLPSTIQTLTLFLTSGGVLLSLYVSASLSYLLYSDILLKFSPTEITAPTMPLDCANASNVQAVNRSATKGVTLLLPEPGWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVAGVDMAL

SEQ ID NO: 30267 - protein, 466 aa, Artificial Sequence
  neuraminidase__InfluenzaB__AHM01056
MLPSTTQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALVFSGVMVSMKEPGWYSFGFEIKDKKCDVPCIGIEMVHDGGKETWHSAATAIYCLMGSGQLLWDTVTGVDMAL

SEQ ID NO: 30268 - protein, 466 aa, Artificial Sequence; identical to SEQ ID NO: 30206
  neuraminidase__InfluenzaB__AHM01067

SEQ ID NO: 30269 - protein, 466 aa, Artificial Sequence; identical to SEQ ID NO: 30175
  neuraminidase__InfluenzaB__AHM01078

SEQ ID NO: 30270 - protein, 466 aa, Artificial Sequence
  neuraminidase__InfluenzaB__AHM01089
MLPSTIQTLTLFLTSGGVLLSLYVSASLSYLLYSDILLKFSPTEITAPTMPLDCANASNVQAVNRSAAKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30271 - protein, 466 aa, Artificial Sequence; identical to SEQ ID NO: 30175
  neuraminidase__InfluenzaB__AHM01100

SEQ ID NO: 30272 - protein, 466 aa, Artificial Sequence; identical to SEQ ID NO: 30206
  neuraminidase__InfluenzaB__AHM01111

SEQ ID NO: 30273 - protein, 466 aa, Artificial Sequence
  neuraminidase__InfluenzaB__AHM01122
MLPSTIQTLTLFLTSGGVLLSLYVSASLSYLLYSDILLKFSPTEITAPTMPLDCANASNVQAVNRSATKGVKLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30274 - protein, 466 aa, Artificial Sequence; identical to SEQ ID NO: 30206
  neuraminidase__InfluenzaB__AHM01133

SEQ ID NO: 30275 - protein, 466 aa, Artificial Sequence
  neuraminidase__InfluenzaB__AHM01144
MLPSTIQTLTLFLTSGGVLLSLYVSASLSYLLYSDILLKFSPTEITAPTMPLDCANASNVQAVNRSAAKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGISECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30276 - protein, 466 aa, Artificial Sequence; identical to SEQ ID NO: 30206
  neuraminidase__InfluenzaB__AHM01166

SEQ ID NO: 30277 - protein, 466 aa, Artificial Sequence
  neuraminidase__InfluenzaB__AHM01188
MLPSTIQTLTLFLTSGGVLLSLYVSASLSYLLYSDILLKFSPTEITAPTMPLDCANASNVQAVNHSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALVFSGVMVSMKEPGWYSFGFEIKDKKCDVPCIGIEMVHDGGKETWHSAATAIYCLMGSGQLLWDTVTGVDMAL

SEQ ID NO: 30278 - protein, 466 aa, Artificial Sequence; identical to SEQ ID NO: 30270
  neuraminidase__InfluenzaB__AHM01199

SEQ ID NO: 30279 - protein, 466 aa, Artificial Sequence
  neuraminidase__InfluenzaB__AHM01210
MLPSTIQTLTLFLTSGGVLLSLYVSASLSYLLYSDILLKFSPTEITAPTMPLDCANASNVQAVNRSATKGVTLLLPEPGWTYPRLSCPGSTFQKALLISPHRFGEAKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVAGVDMAL

SEQ ID NO: 30280 - protein, 466 aa, Artificial Sequence
  neuraminidase__InfluenzaB__AHM01221
MLPSTIQTLTLFLTSGGVLLSLYVSASLSYLLYSDILLKFSPTEITAPTMPLDCANASNFQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30281 - protein, 466 aa, Artificial Sequence; identical to SEQ ID NO: 30175
  neuraminidase__InfluenzaB__AHM01232

SEQ ID NO: 30282 - protein, 466 aa, Artificial Sequence; identical to SEQ ID NO: 30206
  neuraminidase__InfluenzaB__AHM01243

SEQ ID NO: 30283 - protein, 466 aa, Artificial Sequence
  neuraminidase__InfluenzaB__AHM01254
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALVFSGVMVSMKEPGWYSFGFEIKDKKCDVPCIGIEMVHDGGKETWHSAATAIYCLMGSGQLLWDTVTGVDMAL

SEQ ID NO: 30284 - protein, 466 aa, Artificial Sequence
  neuraminidase__InfluenzaB__AHM01265
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDEGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGRLLWDTVTGVDMAL

SEQ ID NO: 30285 - protein, 466 aa, Artificial Sequence
  neuraminidase__InfluenzaB__AHM01276
MLPSTIQTLTLFLTSGGVLLSLYVSASLSYLLYSDILLKFSQTEITAPIMPLDCTNASNVQAVNRSAAKGVTLLLPEPEWTYPRLSCPGSTFQKALLISPHRFGEIKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGVSECRFLKIREGRIIKEIFPTGRVKHTEECTCGFASNKTIECACRDNRYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 30286 - protein, 466 aa, Artificial Sequence; identical to SEQ ID NO: 30270
  neuraminidase__InfluenzaB__AHM01287

SEQ ID NO: 30287 - protein, 466 aa, Artificial Sequence; identical to SEQ ID NO: 30270
  neuraminidase__InfluenzaB__AHM01298

SEQ ID NO: 30288 - protein, 466 aa, Artificial Sequence; identical to SEQ ID NO: 30285
  neuraminidase__InfluenzaB__AHM01309

SEQ ID NO: 30289 - protein, 466 aa, Artificial Sequence; identical to SEQ ID NO: 30206
  neuraminidase__InfluenzaB__AHM01320

SEQ ID NO: 30290 - protein, 466 aa, Artificial Sequence; identical to SEQ ID NO: 30270
  neuraminidase__InfluenzaB__AHM01331

SEQ ID NO: 30291 - protein, 466 aa, Artificial Sequence; identical to SEQ ID NO: 30206
  neuraminidase__InfluenzaB__AHM01342

SEQ ID NO: 30292 - protein, 466 aa, Artificial Sequence
  neuraminidase__InfluenzaB__AHM01353
MLPSTIQTLTLFLTSGGVLLSLYVSASLSYLLYSDILLKFSPTEITAPTMPLDCANASNVQAVNRSATKGVTLLLPEPGWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30293 - protein, 466 aa, Artificial Sequence
  neuraminidase__InfluenzaB__AHM01364
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDEGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30294 - protein, 466 aa, Artificial Sequence; identical to SEQ ID NO: 30285
  neuraminidase__InfluenzaB__AHM01375

SEQ ID NO: 30295 - protein, 466 aa, Artificial Sequence; identical to SEQ ID NO: 30285
  neuraminidase__InfluenzaB__AHM01386

SEQ ID NO: 30296 - protein, 466 aa, Artificial Sequence; identical to SEQ ID NO: 30206
  neuraminidase__InfluenzaB__AHM01397

SEQ ID NO: 30297 - protein, 466 aa, Artificial Sequence; identical to SEQ ID NO: 30206
  neuraminidase__InfluenzaB__AHM01408

SEQ ID NO: 30298 - protein, 466 aa, Artificial Sequence; identical to SEQ ID NO: 30206
  neuraminidase__InfluenzaB__AHM01419

SEQ ID NO: 30299 - protein, 466 aa, Artificial Sequence
  neuraminidase__InfluenzaB__AHM01430
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDEGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGRLLWDTATGVDMAL

SEQ ID NO: 30300 - protein, 466 aa, Artificial Sequence
  neuraminidase__InfluenzaB__AHM01441
MLPSTIQTLTLFLTSGGVLLSLYVSASLSYLLYSDILLKFSQTEITAPTMPLDCANASNVQAVNRSAAKGVTLLLPEPEWTYPRLSCPGSTFQKALLISPHRFGEIKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGVSECRFLKIREGRIIKEIFPTGRVKHTEECTCGFASNKTIECACRDNRYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 30301 - protein, 466 aa, Artificial Sequence; identical to SEQ ID NO: 30206
  neuraminidase__InfluenzaB__AHM01463

SEQ ID NO: 30302 - protein, 466 aa, Artificial Sequence
  neuraminidase__InfluenzaB__AHM01474
MLPSTIQTLTLFLTSGGVLLSLYVSASLSYLLYSDILLKFSQTEITAPIMPLDCINASNVQAVNRSAAKGVTLLLPEPEWTYPRLSCPGSTFQKALLISPHRFGEIKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGVSECRFLKIREGRIIKEIFPTGRVKHTEECTCGFASNKTIECACRDNRYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 30303 - protein, 466 aa, Artificial Sequence
  neuraminidase__InfluenzaB__AHM01485
MLPSTIQTLTLFLTSGGVLLSLYVSASLSYLLYSDILLKFSPTEITAPIMPLDCTNASNVQAVNRSAAKGVTLLLPEPEWTYPRLSCPGSTFQKALLISPHRFGEIKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGVSECRFLKIREGRIIKEIFPTGRVKHTEECTCGFASNKTIECACRDNRYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 30304 - protein, 466 aa, Artificial Sequence; identical to SEQ ID NO: 30285
  neuraminidase__InfluenzaB__AHM01496

SEQ ID NO: 30305 - protein, 466 aa, Artificial Sequence
  neuraminidase__InfluenzaB__AHM01507
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGEIKGNSAPLIVREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGVSECRFLKIREGRIIKEIFPTGRVKHTEECTCGFASNKTIECACRDNRYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSIEEPGWYSFGFEIKDKKCDVPCIGIEMVHDGGKTTWHSAATAIYCLMGSGQLLWDTVTGVDMAL

SEQ ID NO: 30306 - protein, 466 aa, Artificial Sequence; identical to SEQ ID NO: 30285
  neuraminidase__InfluenzaB__AHM01518

SEQ ID NO: 30307 - protein, 466 aa, Artificial Sequence
  neuraminidase__InfluenzaB__AHM01529
MLPSTIQTLTLFLTSGGVLLSLYVSASLSYLLYSDILLKFSQTEITAPIMPLDCTNASNVQAVNRSAAKGVTLLLPEPEWTYPRLSCPGSTFQKALLISPHRFGEIKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGVSECRFLKIREGRIIKEILPTGRVKHTEECTCGFASNKTIECACRDNRYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 30308 - protein, 466 aa, Artificial Sequence; identical to SEQ ID NO: 30175
  neuraminidase__InfluenzaB__AHM01540

SEQ ID NO: 30309 - protein, 466 aa, Artificial Sequence; identical to SEQ ID NO: 30285
  neuraminidase__InfluenzaB__AHM01551

SEQ ID NO: 30310 - protein, 466 aa, Artificial Sequence; identical to SEQ ID NO: 30285
  neuraminidase__InfluenzaB__AHM01562

SEQ ID NO: 30311 - protein, 466 aa, Artificial Sequence; identical to SEQ ID NO: 28792
  neuraminidase__InfluenzaB__AHZ13597

SEQ ID NO: 30312 - protein, 467 aa, Artificial Sequence
  neuraminidase__InfluenzaB__AHZ36701
MLPSTIQMLTLFLTSGGVLLSLYVSASLSYLLYSDILLKFSPTEITAPTMPLDCANASNVHAVNRSATKGVTFLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIRKGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWTDSDALAFRGVMVSMKEPGWYSFGFEIKDKKCDVPCIGIEMVHDGGKETWHSAATAIYCLMGSGQLLWDTVTGVDMAL

SEQ ID NO: 30313 - protein, 467 aa, Artificial Sequence
  neuraminidase__InfluenzaB__AHZ36756
MLPSTIQMLTLFLTSGGVLLSLYVSASLSYLLYSDILLKFSPTEITAPTMPLDCANASNVHAVNRSATKGVTFLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERMGMGLYVKYDGDPWTDSDALAFRGVMVSMKEPGWYSFGFEIKDKKCDVPCIGIEMVHDGGKETWHSAATAIYCLMGSGQLLWDTVTGVDMAL

SEQ ID NO: 30314 - protein, 466 aa, Artificial Sequence
  neuraminidase__InfluenzaB__AHZ36767
MLPSTIQTLTLFLTSGGVLLSLYVSASLSYLLYSDILLKFSPTEITAPTRPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30315 - protein, 466 aa, Artificial Sequence
  neuraminidase__InfluenzaB__AHZ36778
MLPSTIQTLTLFLTSGGVLLSLYVSASLSYLLYSDILLKFPSTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRIQHTEECTCGFASNKTIECACRDNSYTAKRPFVKLNVETDTAEIRLMCTKTYLDTPRPEDGSITGPCESNGGKGSGGIKGGFVHQRMASKIGRWYSRTMSKTERKGMGLYVKYNGDPWADSDALVFSGVMISMEEPGWYSFGFEIKDKKCDVPCIGIEMVHDGGKETWHSAATAIYCLMGSGQLLWDTVTGVNMTL

SEQ ID NO: 30316 - protein, 466 aa, Artificial Sequence
  neuraminidase__InfluenzaB__AHZ36789
MLPSTIQTLTLFLTSGGVLLSLYVSASLSYLLYSDILLKFSPTEITAQTMPLDCANASNVQAVNRSATKGVTLLPPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEMKDKKCDVPCIGIEMVHDGGKETWHSAATAIYCLMGSGQLLWDTVTGVDMAL

SEQ ID NO: 30317 - protein, 466 aa, Artificial Sequence; identical to SEQ ID NO: 30316
  neuraminidase__InfluenzaB__AHZ36800

SEQ ID NO: 30318 - protein, 466 aa, Artificial Sequence
  neuraminidase__InfluenzaB__AHZ36811
MLPSTIQTLTLFLTSGGVLLSLYVSASLSYLLYSDILLKFSQTEITAPIMPLDCTNASNVQAVNRSAAKGVTLLLPEPEWTYPRLSCPGSTFQKALLISPHRFGEIKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGVSECRFLKIREGRIIREIFPTGRVKHTEECTCGFASNKTIECACRDNRYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 30319 - protein, 467 aa, Artificial Sequence; identical to SEQ ID NO: 30313
  neuraminidase__InfluenzaB__AHZ36822

SEQ ID NO: 30320 - protein, 466 aa, Artificial Sequence
  neuraminidase__InfluenzaB__AHZ36833
MLPSTIQTLTLFLTSGGVLLSLYVSASLSYLLYSDILLKFSPTEITAPTRPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKVREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30321 - protein, 466 aa, Artificial Sequence
  neuraminidase__InfluenzaB__AHZ36844
MLPSTIQTLTLFLTSGGVLLSLYVSASLSYLLYSDILLKFSPTEITAPTRPLDCANASNVQAVNRSATKEVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30322 - protein, 466 aa, Artificial Sequence
  neuraminidase__InfluenzaB__AHZ36855
MLPSTIQTLTLFLTSGGVLLSLYVSASLSYLLYSDILLKFSPTEITVQTMPLDCANASNVQAVNRSATKGVTLLPPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEMKDKKCDVPCIGIEMVHDGGKETWHSAATAIYCLMGSGQLLWDTVTGVDMAL

SEQ ID NO: 30323 - protein, 467 aa, Artificial Sequence; identical to SEQ ID NO: 30313
  neuraminidase__InfluenzaB__AHZ36866

SEQ ID NO: 30324 - protein, 466 aa, Artificial Sequence
  neuraminidase__InfluenzaB__AHZ36877
MLPSTIQTLTLFLTSGGVLLSLYVSASLSYLLYSDILLKFSPPEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30325 - protein, 467 aa, Artificial Sequence; identical to SEQ ID NO: 30313
  neuraminidase__InfluenzaB__AHZ36888

SEQ ID NO: 30326 - protein, 467 aa, Artificial Sequence; identical to SEQ ID NO: 30313
  neuraminidase__InfluenzaB__AHZ36899

SEQ ID NO: 30327 - protein, 467 aa, Artificial Sequence; identical to SEQ ID NO: 30313
  neuraminidase__InfluenzaB__AHZ36910

SEQ ID NO: 30328 - protein, 466 aa, Artificial Sequence; identical to SEQ ID NO: 30315
  neuraminidase__InfluenzaB__AHZ36921

SEQ ID NO: 30329 - protein, 466 aa, Artificial Sequence
  neuraminidase__InfluenzaB__AHZ36932
MLPSTIQTLTLFLTSGGVLLSLYVSASLSYLLYSDILLKFSPTEITAQTMPLDCANASNVQAVNRSATKGVTLLPPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTMECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEMKDKKCDVPCIGIEMVHDGGKETWHSAATAIYCLMGSGQLLWDTVTGVDMAL

SEQ ID NO: 30330 - protein, 466 aa, Artificial Sequence
  neuraminidase__InfluenzaB__AHZ36943
MLPSTIQTLTLFLTSGGVLLSLYVSASLSYLLYSDILLKFSPTEITAPTMPLDCANASNVQAVNRSATKGVTLLPPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEMKDRKCDVPCIGIEMVHDGGKETWHSAATAIYCLMGSGQLLWDTVTGVDMAL

SEQ ID NO: 30331 - protein, 467 aa, Artificial Sequence; identical to SEQ ID NO: 30313
  neuraminidase__InfluenzaB__AHZ36954

SEQ ID NO: 30332 - protein, 466 aa, Artificial Sequence
  neuraminidase__InfluenzaB__AHZ36965
MLPSTIQTLTLFLTSGGVLLSLYVSASLSYLLYSDILLKFSPPEINAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30333 - protein, 467 aa, Artificial Sequence; identical to SEQ ID NO: 30313
  neuraminidase__InfluenzaB__AHZ36976

SEQ ID NO: 30334 - protein, 467 aa, Artificial Sequence; identical to SEQ ID NO: 30313
  neuraminidase__InfluenzaB__AHZ36987

SEQ ID NO: 30335 - protein, 466 aa, Artificial Sequence; identical to SEQ ID NO: 30316
  neuraminidase__InfluenzaB__AHZ36998

SEQ ID NO: 30336 - protein, 466 aa, Artificial Sequence
  neuraminidase__InfluenzaB__AHZ37009
MLPSTIQTLTLFLTLGGVLLSLYVSASLSYLLYSDILLKFSPTEITAPTMPLGCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVEADTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30337 - protein, 466 aa, Artificial Sequence; identical to SEQ ID NO: 30314
  neuraminidase__InfluenzaB__AHZ37020

SEQ ID NO: 30338 - protein, 466 aa, Artificial Sequence; identical to SEQ ID NO: 30316
  neuraminidase__InfluenzaB__AHZ37031

SEQ ID NO: 30339 - protein, 466 aa, Artificial Sequence; identical to SEQ ID NO: 30314
  neuraminidase__InfluenzaB__AHZ37042

SEQ ID NO: 30340 - protein, 466 aa, Artificial Sequence; identical to SEQ ID NO: 30316
  neuraminidase__InfluenzaB__AHZ37064

SEQ ID NO: 30341 - protein, 466 aa, Artificial Sequence; identical to SEQ ID NO: 30314
  neuraminidase__InfluenzaB__AHZ37075

SEQ ID NO: 30342 - protein, 466 aa, Artificial Sequence; identical to SEQ ID NO: 30314
  neuraminidase__InfluenzaB__AHZ37086

SEQ ID NO: 30343 - protein, 466 aa, Artificial Sequence
  neuraminidase__InfluenzaB__AHZ37097
MLPSTIQTLTLFLTSGGVLLSLYVSASLSYLLYSDILLKFSPTEITAPTMPLDCANASNVQAVNRSATKGVTLLPPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEMKDKKCDVPCIGIEMVHDGGKETWHSAATAIYCLMGSGQLLWDTVTGVDMAL

SEQ ID NO: 30344 - protein, 466 aa, Artificial Sequence; identical to SEQ ID NO: 30314
  neuraminidase__InfluenzaB__AHZ37108

SEQ ID NO: 30345 - protein, 466 aa, Artificial Sequence
  neuraminidase__InfluenzaB__AHZ41774
MLPSTIQMLTLFLTSGGVLLSLYVSASLSYLLYSDILLKFSPTEITAPTMPLDCANASNVHAVNRSATKGVTFLLPEPEWTYPRLSCPGSTFQKALLISPHRFGETKGNSAPLIIREPFIACGSNECRHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERKGMGLYVKYDGDPWTDNDALAFRGVMVSMKEPGWYSFGFEIKDKKCDVPCIGIEMVHDGGKETWHSAATAIYCLMGSGQLLWDTVTGVDMAL

SEQ ID NO: 30346 - protein, 466 aa, Artificial Sequence; identical to SEQ ID NO: 28956
  neuraminidase__InfluenzaB__AHZ41785

SEQ ID NO: 30347 - protein, 466 aa, Artificial Sequence; identical to SEQ ID NO: 28956
  neuraminidase__InfluenzaB__AHZ41796

SEQ ID NO: 30348 - protein, 466 aa, Artificial Sequence
  neuraminidase__InfluenzaB__AHZ41807
MLPSTIQMLTLFLTSGGVLLSLYVSASLSYLLYSDILLKFSPTEITAPTMPLDCANASNVHAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIEGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERKGMGLYVKYDGDPWTDSDALAFRGVMVSMKEPGWYSFGFEIKDKKCDVPCIGIEMVHDGGKETWHSAATAIYCLMGSGQLLWDTVTGVDMAL

SEQ ID NO: 30349 - protein, 466 aa, Artificial Sequence
  neuraminidase__InfluenzaB__AHZ41818
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMVTDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALVFSGVMVSMKEPGWYSFGFEIKDKKCDVPCIGIEMVHDGGKETWHSAATAIYCLMGSGQLLWDTVTGVNMAL

SEQ ID NO: 30350 - protein, 466 aa, Artificial Sequence; identical to SEQ ID NO: 28956
  neuraminidase__InfluenzaB__AHZ41829

SEQ ID NO: 30351 - protein, 466 aa, Artificial Sequence
  neuraminidase__InfluenzaB__AHZ41840
MLPSTIQMLTLFLTSGGVLLSLYVSASLSYLLYSDILLKFSPTEITAPTMPLDCANASNVHAVNRSATKGVTFLLPEPEWTYPRLSCPGSTFQKALLISPHRFGETKGNSAPLIIREPFIACGPNECRHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMASKIGRWYSRTMSKTERKGMGLYVKYDGDPWTDSDALAFRGVMVSMKEPGWYSFGFEIKDKKCDVPCIGIEMVHDGGKETWHSAATAIYCLMGSGQLLWDTVTGVDMAL

SEQ ID NO: 30352 - protein, 466 aa, Artificial Sequence; identical to SEQ ID NO: 28956
  neuraminidase__InfluenzaB__AHZ41851

SEQ ID NO: 30353 - protein, 466 aa, Artificial Sequence; identical to SEQ ID NO: 30202
  neuraminidase__InfluenzaB__AHZ41862

SEQ ID NO: 30354 - protein, 466 aa, Artificial Sequence
  neuraminidase__InfluenzaB__AHZ41873
MLPSTIQTLTLFLTSGGVLLSLYVSASLSYLLYSDILLKFSPTEITAPTMPLDCANASNAQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALTFSGVMVSMKEPGWYSFGFEIKDKKCDVPCIGIEMVHDGGKETWHSAATAIYCLMGSGQLLWDTVTGVDMAL

SEQ ID NO: 30355 - protein, 466 aa, Artificial Sequence; identical to SEQ ID NO: 28792
  neuraminidase__InfluenzaB__AIL94981

SEQ ID NO: 30356 - protein, 466 aa, Artificial Sequence; identical to SEQ ID NO: 28792
  neuraminidase__InfluenzaB__AIL94992

SEQ ID NO: 30357 - protein, 466 aa, Artificial Sequence; identical to SEQ ID NO: 28817
  neuraminidase__InfluenzaB__AIL95003

SEQ ID NO: 30358 - protein, 466 aa, Artificial Sequence
  neuraminidase__InfluenzaB__AIL95014
MLPSTIQTLTLFLTSGGVLLSLYVSASLSYLLYSDILLKFSQTEITAPIMPLDCANASNVQAVNRSAAKGVTLLLPEPEWTYPRLSCPGSTFQKALLISPHRFGETKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGVSECRFLKIREGRIIKEIFPTGRVKHTEECTCGFASNKTIECACRDNSYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMTL

SEQ ID NO: 30359 - protein, 466 aa, Artificial Sequence; identical to SEQ ID NO: 28817
  neuraminidase__InfluenzaB__AIL95025

SEQ ID NO: 30360 - protein, 466 aa, Artificial Sequence
  neuraminidase__InfluenzaB__AIL95036
MLSSTIQTLTLFLTSGGVLLSLYVSASLSYLLYSDILLKFSPKEITAPTMPLDCANASNVQAVNHSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30361 - protein, 466 aa, Artificial Sequence; identical to SEQ ID NO: 28817
  neuraminidase__InfluenzaB__AIL95047

SEQ ID NO: 30362 - protein, 466 aa, Artificial Sequence; identical to SEQ ID NO: 28926
  neuraminidase__InfluenzaB__AIL95058

SEQ ID NO: 30363 - protein, 466 aa, Artificial Sequence; identical to SEQ ID NO: 28875
  neuraminidase__InfluenzaB__AIL95069

SEQ ID NO: 30364 - protein, 466 aa, Artificial Sequence
  neuraminidase__InfluenzaB__AIL95080
MLPSTIQTLTLFLTSGGVLLSLYVSASLSYLLYSDILLKFSPKEITAPTMPLDCANASNVQAVNHSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACNDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPDDGSITGPCESNGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30365 - protein, 466 aa, Artificial Sequence; identical to SEQ ID NO: 28875
  neuraminidase__InfluenzaB__AIL95091

SEQ ID NO: 30366 - protein, 466 aa, Artificial Sequence; identical to SEQ ID NO: 28817
  neuraminidase__InfluenzaB__AIL95102

SEQ ID NO: 30367 - protein, 466 aa, Artificial Sequence
  neuraminidase__InfluenzaB__AIL95113
MLPSTIQTLTLFLTSGGVLLSLYVSASLSYLLYSDILLKFSPTGITAPTMPLDCANASNVQAVNRSATKGVTLLPPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEMKDKKCDVPCIGIEMVHDGGKETWHSAATAIYCLMGSGQLLWDTVTGVDMAL

SEQ ID NO: 30368 - protein, 466 aa, Artificial Sequence; identical to SEQ ID NO: 30314
  neuraminidase__InfluenzaB__AIL95124

SEQ ID NO: 30369 - protein, 466 aa, Artificial Sequence
  neuraminidase__InfluenzaB__AKA54777
MLPSTIQTLTLFLTSGGVLLSLYVSASLSYLLYSDILLKFSRTEVTAPIMPLDCANASNVQAVNRSATKGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDEGSGGIKGGFVHQRMASKTGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30370 - protein, 466 aa, Artificial Sequence
  neuraminidase__InfluenzaB__AKA54781
MLPSTIQTLTLFLTSGGVLLSLYVSASLSYLLYLDILLKFPSTEITAPTMPLDCANASNVQAVNRSATKGVTFLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIMKEIFPTGRTQHTEECTCGFASNKTIECVCRDNSYTAKRPFVKLNVETDTAEIRLMCTKTYLDTPRPDDGSITGPCESNGGKGSGGIKGGFVHQRMASKIGRWYSRTMSKTERKGMGLYVKYNGDPWADSDALTFSGVMVSMEEPGWYSFGFEIKDKKCDVPCIGIEMVHDGGKETWHSAATAIYCLMGSGQLLWDTVTGVNMTL

SEQ ID NO: 30371 - protein, 466 aa, Artificial Sequence
  neuraminidase__InfluenzaB__AKA54783
MLPSTIQTLTLFLTSGGVLLSLYVSASLSYLLYSDILLKFSRTEVTAPIMPLDCANASNVQAVNRSATKGVTPLFPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDEGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30372 - protein, 466 aa, Artificial Sequence
  neuraminidase__InfluenzaB__AKA54785
MLPSTIQTLTLFLTSGGVLLSLYVSASLSYLLYSDILLKFSRTEVTAPIMPLDCANASNVQAVNRSATKGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGNEGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30373 - protein, 466 aa, Artificial Sequence
  neuraminidase__InfluenzaB__AKA54787
MLPSTIQTLTLFLTSGGVLLSLYVSASLSYLLYSDILLKFSQTEITAPIMPLDCANASNVQAVNHSAAKGVTLLLPEPEWTYPRLSCPGSTFQKALLISPHRFGEIKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYAKNILRTQESACNCIGGDCYLMITDGPASGVSECRFLKIREGRIIKEIFPTGRVKHTEECTCGFASNKTIECACRDNRYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 30374 - protein, 466 aa, Artificial Sequence
  neuraminidase__InfluenzaB__AKA54789
MLPSTIQTLTLFLTSGGVLLSLYVSASLSYLLYSDILLKFSRTEVTAPIMPLDCANASNVQAVNRSATKGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDEGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30375 - protein, 466 aa, Artificial Sequence
  neuraminidase__InfluenzaB__AKA54791
MLPSTIQTLTLFLTSGGVLLSLYVSASLSYLLYSDILLKFSRTEVTAPIMPLDCANASNAQAVNRSATKGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDEGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNITL

SEQ ID NO: 30376 - protein, 466 aa, Artificial Sequence; identical to SEQ ID NO: 30373
  neuraminidase__InfluenzaB__AKA54793

SEQ ID NO: 30377 - protein, 466 aa, Artificial Sequence; identical to SEQ ID NO: 30373
  neuraminidase__InfluenzaB__AKA54795

SEQ ID NO: 30378 - protein, 466 aa, Artificial Sequence; identical to SEQ ID NO: 30374
  neuraminidase__InfluenzaB__AKA54797

SEQ ID NO: 30379 - protein, 466 aa, Artificial Sequence
  neuraminidase__InfluenzaB__AKA54799
MLPSTIQTLTLFLTSGGVLLSLYVSASLSYLLYSDILLKFSQTEITAPIMPLDCANASNVQAVNHSAAKGVTLLLPEPEWTYPRLSCPGSTFQKALLISPHRFGEIKGNSAPLIIREPFIACGPTECKHFALTHYAAQPGGYYNGTREDRNKLRHLISVKLGKIPTVENSIFHMAAWSGSACHDGKEWTYIGVDGPDSNALLKIKYGEAYTDTYHSYEKNILRTQESACNCIGGDCYLMITDGPASGVSECRFLKIREGRIIKEIFPTGRVKHTEECTCGFASNKTIECACRDNRYTAKRPFVKLNVETDTAEIRLMCTETYLDTPRPNDGSITGPCESDGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVDMAL

SEQ ID NO: 30380 - protein, 466 aa, Artificial Sequence; identical to SEQ ID NO: 30374
  neuraminidase__InfluenzaB__AKA54801

SEQ ID NO: 30381 - protein, 466 aa, Artificial Sequence
  neuraminidase__InfluenzaB__AKA54803
MLPSTIQTLTLFLTSGGVLLSLYVSASLSYLLYSDILLKFSRTEVTAPIMPLDCANASNVQAVNRSATNGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDEGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30382 - protein, 466 aa, Artificial Sequence; identical to SEQ ID NO: 30374
  neuraminidase__InfluenzaB__AKA54805

SEQ ID NO: 30383 - protein, 466 aa, Artificial Sequence
  neuraminidase__InfluenzaB__AKA54807
MLPSTIQTLTLFLTSGGVLLSLYVSASLSYLLYSDILLKFSRTEVTAPIMPLDCANASNVQAVNRSATKGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDEGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNITL

SEQ ID NO: 30384 - protein, 466 aa, Artificial Sequence
  neuraminidase__InfluenzaB__AKA54809
MLPSTIQTLTLFLTSGGVLLSLYVSASLSYLLYSDILLKFSRTEVTAPIMPLDCANASNVQAVNRSATKGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDEGSGGIKGGFVHQRMAFKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30385 - protein, 466 aa, Artificial Sequence; identical to SEQ ID NO: 30374
  neuraminidase__InfluenzaB__AKA54811

SEQ ID NO: 30386 - protein, 466 aa, Artificial Sequence
  neuraminidase__InfluenzaB__AKA54813
MLPSTIQTLTLFLTSGGVLLSLYVSASLSYLLYSDILLKFSRTEVTAPIMPLDCANASNVQAVNRSATKGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDEGSGGIKGGFVHQRMASKIGRWYSRTMSKTKRMGMGLYVKYDGDPWTDSEALALSGVMVSIEEPGWYSFGFEIKDKKCDVPCIGIEMVHDGGKTTWHSAATAIYCLMGSGQLLWDTVTGVNMTL

SEQ ID NO: 30387 - protein, 466 aa, Artificial Sequence; identical to SEQ ID NO: 30374
  neuraminidase__InfluenzaB__AKA54815

SEQ ID NO: 30388 - protein, 466 aa, Artificial Sequence
  neuraminidase__InfluenzaB__AKA54817
MLPSTIQTLTLFLTSGGVLLSLYVSASLSYLLYSDILLKFSRTEVTAPIMPLDCANASNVQAVNRSATKGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDEGSGGIKGGFVHQRMASKIGRWYSRTMSKTKRMGMGLYVKYDGDPWTDSEALALSGVMVSMEEPGWYSFGFEIKDKKCDVPCIGVEMVHDGGKTTWHSAATAIYCLMGSGQLLWDTVTGVNMTL

SEQ ID NO: 30389 - protein, 466 aa, Artificial Sequence; identical to SEQ ID NO: 30374
  neuraminidase__InfluenzaB__AKA54819

SEQ ID NO: 30390 - protein, 466 aa, Artificial Sequence; identical to SEQ ID NO: 30374
  neuraminidase__InfluenzaB__AKA54821

SEQ ID NO: 30391 - protein, 466 aa, Artificial Sequence; identical to SEQ ID NO: 30374
  neuraminidase__InfluenzaB__AKA54823

SEQ ID NO: 30392 - protein, 466 aa, Artificial Sequence; identical to SEQ ID NO: 30374
  neuraminidase__InfluenzaB__AKA54825

SEQ ID NO: 30393 - protein, 466 aa, Artificial Sequence; identical to SEQ ID NO: 30374
  neuraminidase__InfluenzaB__AKA54827

SEQ ID NO: 30394 - protein, 466 aa, Artificial Sequence
  neuraminidase__InfluenzaB__AKA54829
MLPSTIQTLTLFLTSGGVLLSLYVSASLSYLLYSDILLKLSRTEVTAPIMPLDCANASNVQAVNRSATKGVTPLLPEPEWTYPRLSCPGSTFQKTLLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDEGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30395 - protein, 466 aa, Artificial Sequence
  neuraminidase__InfluenzaB__AKA54831
MLPSTIQTLTLFLTSGGVLLSLYVSASLSYLLYSDILLKFSRTEVTAPIMPLDCANASNVQAVNRSATKGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGQDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDEGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30396 - protein, 466 aa, Artificial Sequence; identical to SEQ ID NO: 30374
  neuraminidase__InfluenzaB__AKA54833

SEQ ID NO: 30397 - protein, 466 aa, Artificial Sequence
  neuraminidase__InfluenzaB__AKA54837
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETNGNSAPLIVREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGNEGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30398 - protein, 466 aa, Artificial Sequence
  neuraminidase__InfluenzaB__AKA54839
MLPSTIQTLTLFLTSGGVLLSLYVSASLSYLLYSDILLKFSPTEITAPTMPLDCANASNVQAVNRSATKEVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30399 - protein, 466 aa, Artificial Sequence
  neuraminidase__InfluenzaB__AKA54841
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDEGSGGIKGGFVHQRMKSKIGRWYSRTMSKTERMGMGLYVKYDGDPWADSDALAFSGVMVSVKEPGWYSFGFEIKDKKCDVPCIGIEMVHDGGKETWHSAATAIYCLMGSGQLLWDTVTGVDIAL

SEQ ID NO: 30400 - protein, 466 aa, Artificial Sequence
  neuraminidase__InfluenzaB__AKA54843
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDEGSGGIKGGFVHQRMKSKIGRWYSRTMSKTERMGMGLYVKYDGDPWADSDALAFSGVMVSVKEPGWYSFGFEIKDKKCDVPCIGIEMVHDGGKETWHSAATAIYCLMGSGQLLWDTVTGVDMAL

SEQ ID NO: 30401 - protein, 466 aa, Artificial Sequence
  neuraminidase__InfluenzaB__AKA54845
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETNGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDEGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30402 - protein, 466 aa, Artificial Sequence; identical to SEQ ID NO: 30206
  neuraminidase__InfluenzaB__AKA54847

SEQ ID NO: 30403 - protein, 466 aa, Artificial Sequence
  neuraminidase__InfluenzaB__AKA54849
MLPSTIQTLTLFLTSGGVLLSLYVSASLSYLLYSDILLKFSSTEITAPTMPLDCANASNVQAVNRSATKGVTLLLPEPEWTYPRLSCPGSTFQKALLISPHRFGETNGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDEGGGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30404 - protein, 466 aa, Artificial Sequence
  neuraminidase__InfluenzaB__AKA54851
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYIDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30405 - protein, 466 aa, Artificial Sequence
  neuraminidase__InfluenzaB__AKA54853
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDEGSGGVKGGFVHQRMKSKIGRWYSRTMSKTERMGMGLYVKYDGDPWADSDALAFSGVMVSVKEPGWYSFGFEIKDKKCDVPCIGIEMVHDGGKETWHSAATAIYCLMGSGQLLWDTVTGVDMAL

SEQ ID NO: 30406 - protein, 466 aa, Artificial Sequence
  neuraminidase__InfluenzaB__AKA54855
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLDVETDTAEIRLMCTDTYLDTPRPNDGSITGPCESDGDKGSGGIKGGFVHQRMKSKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30407 - protein, 466 aa, Artificial Sequence
  neuraminidase__InfluenzaB__AKT07927
MPPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETRGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRMESKIGRWYSRTMSKTERMGMGLYVKYDGDPWTDSDALAFGGVMVSMKEPGWYSFGFEIKDKKCDVPCIGIEMVHDGGKETWHSAATAIYCLMGSGQLLWDTVTGVDMAL

SEQ ID NO: 30408 - protein, 466 aa, Artificial Sequence; identical to SEQ ID NO: 29119
  neuraminidase__InfluenzaB__AKT07931

SEQ ID NO: 30409 - protein, 466 aa, Artificial Sequence
  neuraminidase__InfluenzaB__AKT07933
MLPSTIQTLTLFLTSGGVLLSLYVSASLSYLLYSDILLKFSPTEITAPAMPLDCANASNVQAVNRSATKGVTFLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30410 - protein, 466 aa, Artificial Sequence; identical to SEQ ID NO: 29119
  neuraminidase__InfluenzaB__AKT07935

SEQ ID NO: 30411 - protein, 466 aa, Artificial Sequence; identical to SEQ ID NO: 29119
  neuraminidase__InfluenzaB__AKT07937

SEQ ID NO: 30412 - protein, 466 aa, Artificial Sequence; identical to SEQ ID NO: 28961
  neuraminidase__InfluenzaB__AKT07939

SEQ ID NO: 30413 - protein, 466 aa, Artificial Sequence; identical to SEQ ID NO: 29119
  neuraminidase__InfluenzaB__AKT07941

SEQ ID NO: 30414 - protein, 466 aa, Artificial Sequence; identical to SEQ ID NO: 29119
  neuraminidase__InfluenzaB__AKT07945

SEQ ID NO: 30415 - protein, 466 aa, Artificial Sequence
  neuraminidase__InfluenzaB__AKT07947
MLPSTIQTLTLFLTSGGVLLSLYVSASLSYLLYSDILLKFSPTEITAPAMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRMESKIGRWYSRTMSKTERMGMGLYVKYDGDPWADSDALAFSGVMVSMKEPGWYSFGFEIKDKKCDVPCIGVDMVHDCGKETWHSAATAIYCLMGSGQLLWDTVTGVDMAL

SEQ ID NO: 30416 - protein, 466 aa, Artificial Sequence; identical to SEQ ID NO: 30374
  neuraminidase__InfluenzaB__AKU40585

SEQ ID NO: 30417 - protein, 466 aa, Artificial Sequence; identical to SEQ ID NO: 30374
  neuraminidase__InfluenzaB__AKU40596

SEQ ID NO: 30418 - protein, 466 aa, Artificial Sequence
  neuraminidase__InfluenzaB__AKU40607
MLPSTIQTLTLFLTSGGVLLSLYVSASLSYLLYSDILLKFSRTEVTAPITPLDCANASNAQAVNRSATKGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDEGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30419 - protein, 466 aa, Artificial Sequence
  neuraminidase__InfluenzaB__AKU40618
MLPSTIQTLTLFLTSGGVLLSLYVSASLSYLLYSDILLKFSRTEVTAPIMPLDCANASNVQAVNRSATKGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDEGSGGIKGGFVHQRMASKIGRWYSRTMSKTKRMGMGLYVKYDGDPWTDSEALALSGVMVSMEEPGWYSFGFEIKDNKCDVPCIGIEMVHDGGKTTWHSAATAIYCLMGSGQLLWDTVTGVNMTL

SEQ ID NO: 30420 - protein, 466 aa, Artificial Sequence
  neuraminidase__InfluenzaB__AKU40640
MLPSTIQTLTLFLTSGGVLLSLYVSASLSYLLYSDILLKFSRTEIAAPIMPLDCANASNVQAVNRSATKGVALLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDNNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTETYLDTPRPNDGSITGPCESNGDKGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30421 - protein, 466 aa, Artificial Sequence; identical to SEQ ID NO: 30374
  neuraminidase__InfluenzaB__AKU40662

SEQ ID NO: 30422 - protein, 466 aa, Artificial Sequence
  neuraminidase__InfluenzaB__AKU40673
MLPSTIQTLTLFLTSGGVLLSLYVSASLSYLLYSDILLKFSRTEVTAPIMPLDCANASNVQAVNRSATKGVTPLLPESEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDEGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30423 - protein, 466 aa, Artificial Sequence; identical to SEQ ID NO: 30374
  neuraminidase__InfluenzaB__AKU40684

SEQ ID NO: 30424 - protein, 466 aa, Artificial Sequence; identical to SEQ ID NO: 30374
  neuraminidase__InfluenzaB__AKU40695

SEQ ID NO: 30425 - protein, 466 aa, Artificial Sequence; identical to SEQ ID NO: 30374
  neuraminidase__InfluenzaB__AKU40706

SEQ ID NO: 30426 - protein, 466 aa, Artificial Sequence; identical to SEQ ID NO: 30374
  neuraminidase__InfluenzaB__AKU40717

SEQ ID NO: 30427 - protein, 466 aa, Artificial Sequence
  neuraminidase__InfluenzaB__AKU40728
MLPSTIQTLTLFLTSGGVLLSLYVSASLSYLLYSDILLKFSRTEVTAPIMPLDCANASNAQAVNRSATKGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDEGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30428 - protein, 466 aa, Artificial Sequence
  neuraminidase__InfluenzaB__AKU40739
MLPSTIQTLTLFLTSGGVLLSLYVSASLSYLLYSDILLKFSRTEVTAPIMPLDCANASNVQAVNRSATKGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGETYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDEGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30429 - protein, 466 aa, Artificial Sequence
  neuraminidase__InfluenzaB__AKU40750
MLPSTIQTLTLFLTSGGVLLSLYVSASLSYLLYSDILLKFSRTEVTAPIMPLDCANASNVQAVNRSATKGVIPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDEGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30430 - protein, 466 aa, Artificial Sequence; identical to SEQ ID NO: 30374
  neuraminidase__InfluenzaB__AKU40761

SEQ ID NO: 30431 - protein, 466 aa, Artificial Sequence; identical to SEQ ID NO: 30374
  neuraminidase__InfluenzaB__AKU40772

SEQ ID NO: 30432 - protein, 466 aa, Artificial Sequence; identical to SEQ ID NO: 30374
  neuraminidase__InfluenzaB__AKU40783

SEQ ID NO: 30433 - protein, 466 aa, Artificial Sequence
  neuraminidase__InfluenzaB__AKU40794
MLPSTIQTLTLFLTSGGVLLSLYVSASLSYLLYSDILLKFSRTEVTAPIMPLDCANTSNVQAVNRSATKGVTPLLPEPEWTYPRLSCPGSTFQKALLISPHRFGETKGKSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDEGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30434 - protein, 466 aa, Artificial Sequence; identical to SEQ ID NO: 30374
  neuraminidase__InfluenzaB__AKU40805

SEQ ID NO: 30435 - protein, 466 aa, Artificial Sequence; identical to SEQ ID NO: 30374
  neuraminidase__InfluenzaB__AKU40816

SEQ ID NO: 30436 - protein, 466 aa, Artificial Sequence; identical to SEQ ID NO: 30374
  neuraminidase__InfluenzaB__AKU40827

SEQ ID NO: 30437 - protein, 466 aa, Artificial Sequence; identical to SEQ ID NO: 30374
  neuraminidase__InfluenzaB__AKU40838

SEQ ID NO: 30438 - protein, 466 aa, Artificial Sequence; identical to SEQ ID NO: 30374
  neuraminidase__InfluenzaB__AKU40849

SEQ ID NO: 30439 - protein, 466 aa, Artificial Sequence; identical to SEQ ID NO: 30374
  neuraminidase__InfluenzaB__AKU40860

SEQ ID NO: 30440 - protein, 466 aa, Artificial Sequence
  neuraminidase__InfluenzaB__AKU40871
MLPSTIQTLTLFLTSGGVLLSLYVSASLSYLLYSDILLKFSRTEVTAPIMPLDCANASNVQAVNRSATKGVAPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDEGSGGIKGGFVHQRMASKIGRWYSRTMSKTKRMGMGLYVKYDGDPWTDSEALTLSGVMVSMEEPGWYSFGFEIKDKKCDVPCIGIEMVHDGGKTTWHSAATAIYCLMGSGQLLWDTVTGVNMTL

SEQ ID NO: 30441 - protein, 466 aa, Artificial Sequence; identical to SEQ ID NO: 30374
  neuraminidase__InfluenzaB__AKU40882

SEQ ID NO: 30442 - protein, 466 aa, Artificial Sequence
  neuraminidase__InfluenzaB__AKU40893
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYDGDPWADSGALAFSGVMVSMKEPGWYSFGFEIKDKKCDVPCIGIEMVHDGGKETWHSAATAIYCLMGSGQLLWDTVTGVDMAL

SEQ ID NO: 30443 - protein, 466 aa, Artificial Sequence; identical to SEQ ID NO: 30374
  neuraminidase__InfluenzaB__AKU40904

SEQ ID NO: 30444 - protein, 466 aa, Artificial Sequence
  neuraminidase__InfluenzaB__AKU40915
MLPSTIQTLTLFLTSGGVLLSLYVSASLSYLLYSDILLKFSRTEVTAPIMPLDCANASNVQAVNRSATKGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDEGSGGIKGGFVHQRMASKIGRWYSRTMSKTKRMGMGLYVKYDGDPWTDSEALALSGVMVPMEEPGWYSFGFEIKDKKCDVPCIGIEMVHDGGKTTWHSAATAIYCLMGSGQLLWDTVTGVNMTL

SEQ ID NO: 30445 - protein, 466 aa, Artificial Sequence; identical to SEQ ID NO: 30374
  neuraminidase__InfluenzaB__AKU40926

SEQ ID NO: 30446 - protein, 466 aa, Artificial Sequence; identical to SEQ ID NO: 30428
  neuraminidase__InfluenzaB__AKU40937

SEQ ID NO: 30447 - protein, 466 aa, Artificial Sequence; identical to SEQ ID NO: 30374
  neuraminidase__InfluenzaB__AKU40948

SEQ ID NO: 30448 - protein, 466 aa, Artificial Sequence; identical to SEQ ID NO: 30374
  neuraminidase__InfluenzaB__AKU40959

SEQ ID NO: 30449 - protein, 466 aa, Artificial Sequence; identical to SEQ ID NO: 30374
  neuraminidase__InfluenzaB__AKU40970

SEQ ID NO: 30450 - protein, 466 aa, Artificial Sequence; identical to SEQ ID NO: 30374
  neuraminidase__InfluenzaB__AKU40981

SEQ ID NO: 30451 - protein, 466 aa, Artificial Sequence; identical to SEQ ID NO: 30374
  neuraminidase__InfluenzaB__AKU40991

SEQ ID NO: 30452 - protein, 466 aa, Artificial Sequence; identical to SEQ ID NO: 30374
  neuraminidase__InfluenzaB__AKU41002

SEQ ID NO: 30453 - protein, 466 aa, Artificial Sequence; identical to SEQ ID NO: 30374
  neuraminidase__InfluenzaB__AKU41013

SEQ ID NO: 30454 - protein, 466 aa, Artificial Sequence; identical to SEQ ID NO: 30374
  neuraminidase__InfluenzaB__AKU41024

SEQ ID NO: 30455 - protein, 466 aa, Artificial Sequence; identical to SEQ ID NO: 28961
  neuraminidase__InfluenzaB__EPI173278

SEQ ID NO: 30456 - protein, 466 aa, Artificial Sequence; identical to SEQ ID NO: 28961
  neuraminidase__InfluenzaB__EPI498049

SEQ ID NO: 30457 - protein, 466 aa, Artificial Sequence; identical to SEQ ID NO: 28961
  neuraminidase__InfluenzaB__AFH57913

SEQ ID NO: 30458 - protein, 466 aa, Artificial Sequence; identical to SEQ ID NO: 28961
  neuraminidase__InfluenzaB__EPI827074

SEQ ID NO: 30459 - protein, 466 aa, Artificial Sequence; identical to SEQ ID NO: 28961
  neuraminidase__InfluenzaB__EPI244698

SEQ ID NO: 30460 - protein, 466 aa, Artificial Sequence; identical to SEQ ID NO: 28961
  neuraminidase__InfluenzaB__EPI244701

SEQ ID NO: 30461 - protein, 466 aa, Artificial Sequence; identical to SEQ ID NO: 30374
  neuraminidase__InfluenzaB__EPI540672

SEQ ID NO: 30462 - protein, 466 aa, Artificial Sequence; identical to SEQ ID NO: 30374
  neuraminidase__InfluenzaB__EPI829465

SEQ ID NO: 30463 - protein, 466 aa, Artificial Sequence
  neuraminidase__InfluenzaB__EPI684428
MLPSTIQTLTLFLTSGGVLLSLYVSASLSYLLYSDILLKFSRTEVTAPTMPLDCANASNVQAVNRSTTKGVTPLFPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGVSECRFLKIREGRIIKEIFPTGRVKHTEECTCGFASNKTIECACRDNRYTAKRPFVKLNVETDTAEIRLMCTKTYLDTPRPNDGSITGPCESDGDEGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30464 - protein, 466 aa, Artificial Sequence; identical to SEQ ID NO: 28983
  neuraminidase__InfluenzaB__AFH58451

SEQ ID NO: 30465 - protein, 466 aa, Artificial Sequence; identical to SEQ ID NO: 28961
  neuraminidase__InfluenzaB__EPI173280

SEQ ID NO: 30466 - protein, 466 aa, Artificial Sequence; identical to SEQ ID NO: 28961
  neuraminidase__InfluenzaB__EPI186302

SEQ ID NO: 30467 - protein, 466 aa, Artificial Sequence
  neuraminidase__InfluenzaB__EPI636339
MLPSTIQTLTLFLTSGGVLLSLYVSASLSYLLYSDILLKFSPTEITAPTMPLDCANASNVQAVNRSATKGVTLLLPEPEWTYPRLSCPGSTFQKALLISPHRFGETKGNSAPLIIREPFVACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANNILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYGGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30468 - protein, 466 aa, Artificial Sequence; identical to SEQ ID NO: 30467
  neuraminidase__InfluenzaB__EPI645996

SEQ ID NO: 30469 - protein, 466 aa, Artificial Sequence
  neuraminidase__InfluenzaB__EPI539770
MLPSTIQTLTLFLTSGGVLLSLYVSASLSYLLYSDILLKFSRTEVTAPIMPLDCANASNAQAVNRSATKGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDEGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATTIYCLMGSGQLLWDTVTGVNITL

SEQ ID NO: 30470 - protein, 466 aa, Artificial Sequence; identical to SEQ ID NO: 30469
  neuraminidase__InfluenzaB__EPI551248

SEQ ID NO: 30471 - protein, 466 aa, Artificial Sequence; identical to SEQ ID NO: 30469
  neuraminidase__InfluenzaB__EPI544258

SEQ ID NO: 30472 - protein, 466 aa, Artificial Sequence; identical to SEQ ID NO: 30374
  neuraminidase__InfluenzaB__EPI592698

SEQ ID NO: 30473 - protein, 466 aa, Artificial Sequence; identical to SEQ ID NO: 30374
  neuraminidase__InfluenzaB__EPI592706

SEQ ID NO: 30474 - protein, 466 aa, Artificial Sequence
  neuraminidase__InfluenzaB__EPI693093
MLPSTIQTLTLFLTSGGVLLSLYVSASLSYLLYSDILLKFSRTEVTAPIMPLDCANASNVQAVNRSATKGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDEGSGGIKGGFVHQRMESKIGRWYSRTMSKTKRMGMGLYVKYDGDPWTDSEALALSGVMVSMEEPGWYSFGFEIKDKKCDVPCIGIEMVHDGGKTTWHSAATAIYCLMGSGQLLWDTVTGVNMTL

SEQ ID NO: 30475 - protein, 466 aa, Artificial Sequence
  neuraminidase__InfluenzaB__EPI678795
MLPSTIQTLTLFLTSGGVLLSLYVSASLSYLLYSDILLKFSPTEITAPTMPLDCANASNVQAVNRSATKGVTFLLPEPEWTYPRLSCPGSTFQKALLISPHRFGETKGNSAPLIIREPFVACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANNILRTQESACNCIGGNCYLMITDGSASGVSECRFLKIREGRIIKEIFPTGRVKHTEECTCGFASNKTIECACRDNRYTAKRPFVKLNVETDTAEIRLMCTDTYLDTPRPNDGSITGPCESDGDKGSGGIKGGFVHQRMKSKIGRWYSRTMSKTERMGMGLYVKYGGNPWADSDALTFSGVMVSMKEPGWYSFGFEIKDKKCDVPCIGIEMVHDGGKETWHSAATAIYCLMGSGQLLWDTVTGVDMAL

SEQ ID NO: 30476 - protein, 466 aa, Artificial Sequence; identical to SEQ ID NO: 30475
  neuraminidase__InfluenzaB__EPI721063

SEQ ID NO: 30477 - protein, 466 aa, Artificial Sequence; identical to SEQ ID NO: 28895
  neuraminidase__InfluenzaB__EPI328903

SEQ ID NO: 30478 - protein, 466 aa, Artificial Sequence
  neuraminidase__InfluenzaB__EPI543192
MLPSTIQTLTLFLTSGGVLLSLYVSASLSYLLYLDILLKFPSTEITAPTMPLDCANASNVQAVNRSATKGVTLLLPEPEWTYPRLSCPGSTFQKALLISPHRFGETKGNSAPLIIREPFIACGPKECKHFALTHYAAQPGGYYNGTRGDRNKLRHLISVKLGKIPTVENSIFHMAAWSGSACHDGKEWTYIGVDGPDNNALLKIKYGEAYTDTYHSYANNILRTQESACNCIGGNCYLMITDGSASGVSECRFLKIREGRIMKEIFPTGRTQHTEECTCGFASNKTIECACRDNSYTAKRPFVKLNVETDTAEIRLMCTKTYLDTPRPDDGSITGPCESNGGKGSGGIKGGFVHQRMASKIGRWYSRTMSKTERKGMGLYIKYNGDPWADSDALTFSGVMVSMEEPGWYSFGFEIKDKKCDVPCIGIEMVHDGGKETWHSAATAIYCLMGSGQLLWDTVTGVNMTL

SEQ ID NO: 30479 - protein, 466 aa, Artificial Sequence; identical to SEQ ID NO: 30478
  neuraminidase__InfluenzaB__EPI500360

SEQ ID NO: 30480 - protein, 466 aa, Artificial Sequence
  neuraminidase__InfluenzaB__EPI543186
MLPSTIQTLTLFLTSGGVLLSLYVSASLSYLLYSDILLKFSRTEVTAPIMPLDCANASNVQAVNRSATKGVTPLLPEPEWTYPRLSCPGSTFQKALLISPHRFGETKGNSAPLIIREPFIACGPKECKHFALTHYAAQPGGYYNGTREDRNKLRHLISVKLGKIPTVENSIFHMAAWSGSACHDGREWTYIGVDGPDSNALLKIKYGEAYTDTYHSYAKNILRTQESACNCIGGDCYLMITDGPASGISECRFLKIREGRIIKEIFPTGRVKHTEECTCGFASNKTIECACRDNSYTAKRPFVKLNVETDTAEIRLMCTKTYLDTPRPNDGSITGPCESDGDEGSGGIKGGFVHQRMASKIGRWYSRTMSKTKRMGMGLYVKYDGDPWTDSEALALSGVMVSMEEPGWYSFGFEIKDKKCDVPCIGIEMVHDGGKTTWHSAATVIYCLMGSGQLLWDTVTGVNMTL

SEQ ID NO: 30481 - protein, 466 aa, Artificial Sequence; identical to SEQ ID NO: 30480
  neuraminidase__InfluenzaB__EPI536448

SEQ ID NO: 30482 - protein, 466 aa, Artificial Sequence
  neuraminidase__InfluenzaB__NP_056663
MLPSTVQTLTLLLTSGGVLLSLYVSASLSYLLYSDVLLKFSSTKTTAPTMSLECTNASNAQTVNHSATKEMTFPPPEPEWTYPRLSCQGSTFQKALLISPHRFGEIKGNSAPLIIREPFVACGPKECRHFALTHYAAQPGGYYNGTRKDRNKLRHLVSVKLGKIPTVENSIFHMAAWSGSACHDGREWTYIGVDGPDNDALVKIKYGEAYTDTYHSYAHNILRTQESACNCIGGDCYLMITDGSASGISKCRFLKIREGRIIKEILPTGRVEHTEECTCGFASNKTIECACRDNSYTAKRPFVKLNVETDTAEIRLMCTKTYLDTPRPDDGSIAGPCESNGDKWLGGIKGGFVHQRMASKIGRWYSRTMSKTNRMGMELYVKYDGDPWTDSDALTLSGVMVSIEEPGWYSFGFEIKDKKCDVPCIGIEMVHDGGKDTWHSAATAIYCLMGSGQLLWDTVTGVDMAL

SEQ ID NO: 30483 - protein, 466 aa, Artificial Sequence
  neuraminidase__InfluenzaB__ABG85180
MLPSTVQTLTLLLTSGGVLLSLYVSASLSYLLYSDVLLKFSSTKTTAPTMSLECTNASNAQTVNYSATKEMTFPPPEPEWTYPRLSCQGSTFQKALLISPHRFGEIKGNSAPLIIREPFVACGPKECRHFALTHYAAQPGGYYHGTRKDRNKLRHLVSVKLGKIPTVENSIFHMAAWSGSACHDGREWTYIGVDGPDNDALVKIKYGEAYTDTYHSYAHNILRTQESACNCIGGDCYLMITDGSASGISKCRFLKIREGRIIKEILPTGRVEHTEECTCGFASNKTIECACRDNSYTAKRPFVKLNVETDTAEIRLMCTKTYLDTPRPDDGSIAGPCESNGDKGLGGIKGGFVHQRMAFKIGRWYSRTMSKTNRMGMELYVKYDGDPWTDSDALTLSGVMVSIEEPGWYSFGFEIKDKKCDVPCIGIEMVHDGGEDTWHSAATAIYCLMGSGQLLWDTVTGIDMAL

SEQ ID NO: 30484 - protein, 466 aa, Artificial Sequence; identical to SEQ ID NO: 30373
  neuraminidase__InfluenzaB__EPI376345

SEQ ID NO: 30485 - protein, 466 aa, Artificial Sequence; identical to SEQ ID NO: 30373
  neuraminidase__InfluenzaB__EPI368424

SEQ ID NO: 30486 - protein, 466 aa, Artificial Sequence
  neuraminidase__InfluenzaB__EPI331150
MLPSTIQTLTLFLTSGGVLLSLYVSASLSYLLYSDILLKFSPTEITAPTMPLDCANASNVQAMNRSATKGVTLLLPEPEWTYPRLSCPGSTFQKALLISPHRFGETKGNSAPLIIREPFIACGPNECKHFALTHYAAQPGGYYNGTRGDRNKLRHLISVKLGKIPTVENSIFHMAAWSGSACHDGKEWTYIGVDGPDNNALLKVKYGEAYTDTYHSYANKILRTQESACNCIGGNCYLMITDGSASGVSECRFLKIREGRIIKEIFPTGRVKHTEECTCGFASNKTIECACRDNSYTAKRPFVKLNVETDTAEIRLMCTDTYLDTPRPNDGSITGPCESDGDKGSGGIKGGFVHQRMESKIGRWYSRTMSKTERMGMGLYVKYDGDPWADSDALAFSGVMVSMKEPGWYSFGFEIKDKKCDVPCIGIEMVHDGGKETWHSAATAIYCLMGSGQLLWDTVTGVDMAL

SEQ ID NO: 30487 - protein, 466 aa, Artificial Sequence; identical to SEQ ID NO: 30486
  neuraminidase__InfluenzaB__EPI358089

SEQ ID NO: 30488 - protein, 466 aa, Artificial Sequence; identical to SEQ ID NO: 28632
  neuraminidase__InfluenzaB__ABL76698

SEQ ID NO: 30489 - protein, 466 aa, Artificial Sequence
  neuraminidase__InfluenzaB__AAD42328
MLPSTIQTLTLFLTSGGVLLSLYVSASLSYLLYSDILLKFSPTEITAPTMPLDCANASNVQAVNRSATKGMTLLLPEPEWTYPRLSCPGSTFQKALLISPHRFGETRGNSAPLTIREPFIACGPKECKHFALTHYAAQPGGYYNGTREDRNKLRHLISVKLGKIPTVENSIFHMAAWSGSACHDGREWTYIGVDGPDSNALIKIKYGEAYTDTYHSYANNILRTQESACNCIGGDCYLMITDGSASGISKCRFLKIREGRIIKEIFPTGRVEHTEECTCGFASNKTIECACRDNSYTAKRPFVKLNVETDTAEIRLMCTETYLDTPRPDDGSITGPCESNGDKGRGGIKGGFVHQRMASKIGRWYSRTMSKTKRMGMELYVKYDGDPWIDSDALAPSGVMVSMEEPGWYSFGFEIKDKKCDVPCIGIEMVHDGGKKTWHSAATAIYCLMGSGQLLWDTVTGVDRSV

SEQ ID NO: 30490 - protein, 466 aa, Artificial Sequence; identical to SEQ ID NO: 30175
  neuraminidase__InfluenzaB__EPI541349

SEQ ID NO: 30491 - protein, 466 aa, Artificial Sequence; identical to SEQ ID NO: 30374
  neuraminidase__InfluenzaB__EPI541759

SEQ ID NO: 30492 - protein, 466 aa, Artificial Sequence; identical to SEQ ID NO: 30467
  neuraminidase__InfluenzaB__EPI826201

SEQ ID NO: 30493 - protein, 466 aa, Artificial Sequence; identical to SEQ ID NO: 30206
  neuraminidase__InfluenzaB__EPI477398

SEQ ID NO: 30494 - protein, 466 aa, Artificial Sequence; identical to SEQ ID NO: 30206
  neuraminidase__InfluenzaB__EPI492570

SEQ ID NO: 30495 - protein, 466 aa, Artificial Sequence; identical to SEQ ID NO: 30206
  neuraminidase__InfluenzaB__EPI498339

SEQ ID NO: 30496 - protein, 466 aa, Artificial Sequence; identical to SEQ ID NO: 30427
  neuraminidase__InfluenzaB__EPI538118

SEQ ID NO: 30497 - protein, 466 aa, Artificial Sequence; identical to SEQ ID NO: 30427
  neuraminidase__InfluenzaB__EPI538124

SEQ ID NO: 30498 - protein, 466 aa, Artificial Sequence; identical to SEQ ID NO: 30427
  neuraminidase__InfluenzaB__EPI556421

SEQ ID NO: 30499 - protein, 466 aa, Artificial Sequence; identical to SEQ ID NO: 30427
  neuraminidase__InfluenzaB__EPI614609

SEQ ID NO: 30500 - protein, 466 aa, Artificial Sequence; identical to SEQ ID NO: 28671
  neuraminidase__InfluenzaB__BAB32609

SEQ ID NO: 30501 - protein, 466 aa, Artificial Sequence; identical to SEQ ID NO: 28817
  neuraminidase__InfluenzaB__EPI271544

SEQ ID NO: 30502 - protein, 466 aa, Artificial Sequence; identical to SEQ ID NO: 28817
  neuraminidase__InfluenzaB__AFH57957

SEQ ID NO: 30503 - protein, 466 aa, Artificial Sequence; identical to SEQ ID NO: 28817
  neuraminidase__InfluenzaB__EPI294881

SEQ ID NO: 30504 - protein, 466 aa, Artificial Sequence; identical to SEQ ID NO: 28672
  neuraminidase__InfluenzaB__ABL77259

SEQ ID NO: 30505 - RNA, 1701 nt, Artificial Sequence
  hemagglutinin__InfluenzaA__AAA16879
auggaagcaaaacuauuuguacuauucuguacauucacuguacugaaagcugacaccaucugugugggcuaccaugcaaacaacucuacagacacuguugacacaguacuggaaaagaaugugaccgugacucacucagugaauuugcucgaagacagccauaaugggaaacucugcagccugaacgggauagcuccccuacaauuggggaagugcaauguagcgggauggcuccuuggcaauccagaaugugaccuucuacucacugcaaacucaugguccuauauaauagagacuuccaauucagaaaacggaacaugcuaucccggugaauucauagauuaugaagaauuaagagagcagcuaaguucaguuucuucauuugaaaaguuugaaauuuucccgaaagcaagcucauggccaaaucaugagacaacuaaaggugucacagccgcaugcucuuacucuggagccagcaguuuuuaucggaacuugcuguggauaacaaagaagggaacuucauaucccaaacucagcaaaucauacacgaacaauaaggggaaagaagugcuugugcucuggggggugcaccacccuccaacuaccagugagcaacaaagucuauaccagaacgcugaugcauaugucucaguuggaucaucaaaauacaaccgaagauuuacuccggaaauagcagcuagaccuaaaguuagaggacaggcaggcaggaugaacuauuauuggacacuauuagaccaaggagauaccauaacauuugaagccacugggaauuugauagcaccaugguaugcuuucgcacugaauaaggggucugacucuggaauuauaacaucagaugcuccaguucacaauugugacacaaggugccaaaccccucauggggcuuugaacaguagccuuccuuuucagaauguacauccuaucacuauuggagaaugucccaaauacaucaagagcaccaagcuaagaauggcaacaggacuaagaaaugucccauccauucaguccagaggacuauuuggagcaauugcuggauucauugagggaggauggacaggcaugauagauggaugguacggguaccaucaccagaaugagcagggaucaggauaugcugcugaucagaaaagcacacagaaugcgaucgacggaaucacaaauaaggugaauucgguaauugaaaagaugaacacucaauucacugcagugggcaaggaauucaacaauuuagaaaggagaauugaaaaucugaauaagaaggucgaugauggauuccuggauguuuggacauacaaugccgagcugcucguucuacuugaaaaugaaaggacucuggacuuucaugauuccaaugugagaaauuuauaugagaaggucaaaucacaauugaggaauaaugccaaagaacuugggaaugguuguuuugaguucuaccacaagugugaugaugagugcauggaaagagagaagaacggcacauaugacuaucccaaauauucagaagaguccaaauugaaucgagaggaaauagacggagugaaacuagagucaaugggaguuuaccaaauuuuggcgaucuauuccacagucgccaguucucuagucuuguuagucucccugggggcaaucagcuucuggaugugcucuaaugggucauugcaaugcagaauaugcauuuag

SEQ ID NO: 30506 - RNA, 1701 nt, Artificial Sequence
  hemagglutinin__InfluenzaA__AAA16880
auggaagcaaaacuauuugugcuauucuguacauucacuguacugaaagcugacaccaucugugugggcuaccaugcaaacaacucuacagacacuguugacacaguacuagaaaagaaugugaccgugacucacucagugaauuugcucgaagacagccauaaugggaagcucugcagucugaacggaauagcuccccuacaacugggaaagugcaauguggcgggauggcuccuuggcaauccagagugugaccuucuacucacugcaaacucaugguccuacauaauagaaacuucaaauucagaaaacggaacaugcuaccccggugaauuuauagauuaugaagaguuaagagagcagcuaaguucaguuucuucauuugaaaaguuugaaauuuucccgaaggcaagcucauggccaaaucaugagacaacuaaagguguuacagcugcaugcucuuacucuggagccagcaguuuuuaucggaauuugcuguggauaacaaagaagggaacuucauauccaacacucagcaaaucauacacgaacaauaaggggaaagaagugcuugugcucuggggggugcaccacccuccaacugucaaugagcaacaaagucuauaccagaacgcugaugcauauguuucaguuggaucaucaaaauacaaccgaagauucacuccagaaauagcagcuagaccuaaaguuagaggacaggcaggcagaaugaacuaucauuggacacuauuagaccaaggagacaccauaacguuugaagccaccgggaauuugauagcaccaugguaugcuuucgcauugaauaaggggucugacucuggaauuauaacaucagaugcuccaguucauaacugugacacaaggugucaaaccccucauggggcuuugaacagcagccuuccuuuucagaauguacauccuaucacuauuggagaaugucccaaauacgucaaaagcaccaagcuaagaauggcaacaggacuaagaaauguuccauccauucaauccagaggacuauuuggagcaauugcuggauucauugagggaggauggacaggcaugauagaugggugguacggguaucaucaucagaaugagcagggaucaggauaugcugccgaucagaaaagcacacagaaugcgaucgacgggaucacaaauaaggugaauucggugauugagaagaugaacacuaaauucacugcagugggcaaggaauucaacaauuuagaaaggagaauugaaaauuuaaauaagaaggucgaugauggauuccuggauguuuggacauacaaugccgaacugcucguccuacuugaaaaugagaggacucuggacuuucaugacuccaaugugagaaauuuauaugagaaggucaaaucacaauugaggaauaaugccaaagaacuugggaaugguuguuuugaguucuaccacaagugugaugaugagugcauagaaagugugaagaacggcacauaugacuaucccaaauauucagaagaguccaaauugaaccgagaagaaauagacggagugaaacuagaaucgaugggaguuuaucaaauuuuggcgaucuauuccacagucgccaguucucuagucuuguuagucucccugggggcaaucagcuucuggaugugcucuaaugggucauugcaaugcagaauaugcauuuag

SEQ ID NO: 30507 - RNA, 1689 nt, Artificial Sequence
  hemagglutinin__InfluenzaA__AAA64362
auggccaucauuuaucucauucuccuguucacagcagugagaggggaccagauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaauaucuccucagcagcgugaaacauuucgagaaaguaaagauucugcccaaagauagauggacacagcauacaacaacuggagguucacgggccugcgcggugucugguaauccaucauucuucaggaacauggucuggcugacaaagaaaggaucagauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccagaaauagcaacaaggccuaaagugaauggacuaggaaguagaauggaauucucuuggacccucuuggauaugugggacaccauaaauuuugagaguacugguaaucuaauugcaccagaguauggauucaaaauaucgaaaagagguaguucagggaucaugaaaacagaaggaacacuugagaacugugagaccaaaugccaaacuccuuugggagcaauaaauacaacauugccuuuucacaauguccacccacugacaauaggugagugccccagauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcauauga

SEQ ID NO: 30508 - RNA, 1689 nt, Artificial Sequence
  hemagglutinin__InfluenzaA__AAA64363
auggccaucauuuaucucauucuccuguucacagcagugagaggggaccagauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaacgauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacauggucuggcugacaaagaaaggaucaaauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccagacauagcaacaaggccuaaagugaauggacaaggagguagaauggaauucucuuggacccuauuggauaugugggacaccauaaauuuugagaguacugguaaucuaauugcaccagaguauggauucaaaauaucgaaaagagguaguucagggaucaugaaaacagaaggaacacuugggaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagauaaacacccaauuugaagcuguugagaaagaauucaguaacuuagagagaagacuggagaacuugaacaaaaagauggaagacggguuucuagauguguggacauacaaugcugagcuucuaguucugauggaaaaugagaggacacuugacuuucaugauucuagugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggauuuaucaaauccuugccauuuaugcuacaguagcagguucucugucacuggcaaucaugauggcugggaucucuuucuggaugugcuccaacgggucucugcagugcaggaucugcauauga

SEQ ID NO: 30509 - RNA, 1689 nt, Artificial Sequence
  hemagglutinin__InfluenzaA__AAA64365
auggccaucauuuaucucauucuccuguucacagcagugagaggggaccagauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaacgauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacauggucuggcugacaaagaaaggaucaaauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccagacauagcaacaaggccuaaaguggauggacuaggaaguagaauggaauucucuuggacccuauuggauaugugggacaccauaaauuuugagaguacugguaaucuaauugcaccagaguauggauucaaaauaucgaaaagagguaguucagggaucaugaaaacagaaggaacacuugggaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugagaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguauaauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggauuuaucaaauccuugccauuuaugcuacaguagcagguucucugucacuggcaaucaugauggcugggaucucuuucuggaugugcuccaacgggucucugcagugcaggaucugcauauga

SEQ ID NO: 30510 - RNA, 1689 nt, Artificial Sequence
  hemagglutinin__InfluenzaA__AAA64366
auggccaucauuuaucuaauucuccuguucacagcagugagaggggaccaaauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacauggucuggcugacaaagaaagaaucaaauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccagacauagcaacaaggccuaaagugaauggacuaggaaguagaauggaauucucuuggacccuauuggauaugugggacaccauaaauuuugagaguacugguaaucuaauugcaccagaguauggauucaaaauaucgaaaagagguaguucagggaucaugaaaacagaaggaacacuugagaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcauauga

SEQ ID NO: 30511 - RNA, 1701 nt, Artificial Sequence
  hemagglutinin__InfluenzaA__AAA85781
augaagacuaucauugcuuugagcuacauuuucugucugguuuucgcccaagaccuuccaggaaaugacaacagcacagcaacucuuugccugggacaucaugcggugccaaacggaacgcuagugaaaacaaucacgaaugaucagauugaagugacuaaugcuacugaacugguucagaguuccucaacggguaaaauaugcgacaauccucaucgaauccuugauggaauaaacugcacacugauagaugcucuauugggggacccucauugugauggcuuucaaaaugagaaaugggaccuuuucguugaacgcagcaaagcuuucagcaacuguuacccuuaugaugugccagauuaugccucccuuaggucacuaguugccucgucaggcacucuggaguuuaucaaugaaggcuucaauuggacuggggucacucagaaugggggaagcagugcuugcaaaaggggaccugauaacgguuuuuucaguagacugaacugguuguacaaaucaggaagcacauauccagugcagaacgugaccaugccaaacaaugacaacucugacaaacuauacauuugggggguucaccacccgagcacggacaaagaacaaaccaaccuauauguucaagcaucagggaaagucacagucuccaccaagagaagccagcaaacuguaaucccgaaugucgggucuagacccuggguaaggggucuaucuaguagaguaagcaucuauuggacaauaguuaaaccgggagacauacugguaauuaauaguaauggaaaccuaauugcuccucgggguuacuacaaaaugcgcacugggaaaagcucaauaaugaggucagaugcaccuauuggcacuugcagcucugaaugcaucacuccaaauggaagcauucccaaugacaagcccuuucaaaacguaaacaagaucacauauggggcaugucccaaguauguuaagcaaaacacucuaaaguuggcaacagggaugcggaauguaccagagaaacaaaucagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaauccuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 30512 - RNA, 1707 nt, Artificial Sequence
  hemagglutinin__InfluenzaA__AAC14418
auggagagaauagugcuucuucuugcaacagucagucuuguuaaaagugaccagauuugcauugguuaccaugcaaacaacucgacagagcagguugacacaauaauggaaaagaauguuacuguuacacaugcccaagacauacuggaaaggacacacaacgggaagcucugcgaucuaaauggagugaagccucugauuuugagggauuguaguguagcuggauggcuccucggaaacccuaugugugacgaauucaucaaugugccggaauggucuuacauaguggagaaggccaguccagccaaugaccucuguuauccagggaauuucaacgacuaugaagaacugaaacaccuauugagcagaauaaaccauuuugagaaaauucagaucauccccaaaaguucuugguccaaucaugaugccucaucagggguaagcucagcauguccauaccuugggagguccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuacauuuccguuggaacaucaacacugaaccagagauugguuccagaaauagcuacuagacccaaaguaaacgggcaaaguggaagaauggaguucuucuggacaauuuuaaagccgaaugaugccaucaauuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuaguaugccauuccacaacauacacccccucaccaucggggaaugccccaaauaugugaaaucaaacagauuaguccuugcgacuggacucagaaaugccccucaaagagagagaagaagaaaaaagagaggacuauuuggagcuauagcagguuuuauagagggaggauggcagggaaugguagaugguugguauggguaccaccauagcaaugagcaggggaguggauacgcugcagaccaagaauccacucaaaaggcaauagauggagucaccaauaaggucaacucgaucauuaacaaaaugaacacucaguuugaggccguuggaagggaauuuaauaacuuggaaaggaggauagagaauuuaaacaagaagauggaagacggauuccuagaugucuggacuuacaaugccgaacuucugguucucauggaaaaugagagaacucuagacuuucaugacucaaaugucaagaaccuuuacgacaagguccgacuacagcuuagggauaaugcaaaggagcuggguaaugguuguuucgaauucuaucacaaaugugauaacgaauguauggaaaguguaaaaaacggaacguaugacuacccgcaguauucagaagaagcaagacuaaacagagaggaaauaaguggaguaaaauuggaaucaaugggaacuuaccaaauacugucaauuuauucaacaguggcgaguucccuagcacuggcaaucaugguagcuggucuaucuuuauggaugugcuccaauggaucguuacaaugcagaauuugcauuuaa

SEQ ID NO: 30513 - RNA, 1707 nt, Artificial Sequence
  hemagglutinin__InfluenzaA__AAC40508
auggaaagaacagugcuucuucuugcaacagucagucuuguuaaaagugaucagauuugcauugguuaccaugcaaacaacucgacagagcagguugacacaauaauggaaaagaauguuacuguuacacaugcccaagacauacuggaaaggacacacaacgggaagcucugcgaucuaaauggagugaagccucucauuuugagggauuguaguguagcuggauggcuccucggaaacccuaugugugacgaauucaucaaugugccggaauggucuuacauaguggagaaggccaguccagccaaugaccucuguuauccagggaauuucaacgacuaugaagaacugaaacaccuauugagcagaauaaaccauuuugagaaaauucagaucauccccaaaaguucuugguccaaucaugaugccucaucaggggugagcucagcauguccauaccuugggagguccuccuuuuucagaaaugugguauggcuuaucaaaaagaacagugcauacccaacaauaaagaggagcuacaauaauaccaaccaagaagaucuuuugguacugugggggguucaccauccuaaugaugcggcagagcagacaaagcucuaucaaaauccaaccaccuacauuuccguuggaacaucaacacugaaccagagauugguuccagaaauagcuacuagacccaaaguaaacgggcaaaguggaagaauggaguucuucuggacaauuuuaaagccgaaugaugccaucaauuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuaguaugccauuccacaacauacacccccucaccaucggggaaugccccaaauaugugaaaucaaacagauuaguccuugcgacuggacucagaaauaccccucaaagagagagaagaagaaaaaagagaggacuauuuggagcuauagcagguuuuauagagggaggauggcagggaaugguagaugguugguauggguaccaccauagcaaugagcaggggaguugcuacucugcagacaaagaauccacucaaaaggcaauagauggagucaccaauaaggucaacucgaucauuaacaaaaugaacacucaguuugaggccguuggaagggaauuuaauaacuuggaaaggaggauagagaauuuaaacaagaagauggaagacggauuccuagaugucuggacuuacaaugcugaacuucugguucucauggaaaaugagagaacucucgacuuucaugacucaaaugucaagaaccuuuacgacaagguccgacuacagcuuagggauaaugcaaaggagcuggguaaugguuguuucgaauucuaucacaaaugugauaaugaauguauggaaaguguaaaaaacggaacguaugacuacccgcaguauucagaagaagcaagacuaaacagagaggaaauaaguggaguaaaauuggaaucaaugggaacuuaccaaauacugucaauuuauucaacaguggcgaguucccuagcacuggcaaucaugguagcuggucuaucuuuauggaugugcuccaauggaucguuacaaugcagaauuugcauuuaa

SEQ ID NO: 30514 - RNA, 1701 nt, Artificial Sequence
  hemagglutinin__InfluenzaA__AAF87274
augaaggcaauacuaguagucuugcuauauacauuuacaaccgcaaaugcagacacauuauguauagguuaccaugcaaauaauucaacugacacuguugacacaguacuagaaaaaaauguaacaguaacacacucuguuaaccuucuagaaaacagacauaacgggaaacuauguaaacuaaaagggguagccccauugcauuuggguaaauguaacauugcuggauggcuccugggaaacccagagugugaauuacuauucacagcaagcucauggucuuacauuguggaaacuucuaauucagacaaugggacauguuacccaggagauuucaucaauuaugaagagcuaagagagcaguugagcucagugucaucauuugaaagauuugagauauuccccaaggcaaauucauggcccaaucaugaaacgaacagaggugugacaucagcguguccuuaugcuggagcaaacagcuucuacagaaacuuaauauggcugguaaaaaaaggaaauucauacccaaaacucagcaaauccuauauuaacaauaaggggaaggaaguccucgugcuauggggcauucaccauccaccuaccaguaaugaucaacaaagucucuaccagaaugcagaugccuauguuuuuguggggucaucaaaauacaacaagaaauucaugccagaaauagcaacaagacccaaagugagaggucaagcagggagaaugaacuauuacuggacacuaauagagccuggagacacaauaacauucgaagcaacuggaaaccuaguggcaccaagauaugccuucgcaauggaaagaggcucuggaucugguauuaucauuucagauacaccaguccacgauuguaaugcgaccugucaaacacccaaaggugcuauaaacaccaaucuuccauuucaaaauauacauccagucacgauuggagaauguccaaaauaugucaaaagcacaagauugagaauggcuacaggauuaaggaauaucccgucuauucaaucuagaggccuguuuggagccauugcuggcuuuauugaggggggauggacaggaaugauagauggaugguaugguuaccaucaccaaaaugagcagggaucaggauaugcagcagaccgaaagagcacacagaaugccauagacgggaucacuaacaaaguaaacucuguuauugaaaagaugaacacacaauucacagcaguggguaaagaauucaaucaccuggaaaaaagaauaaagaauuuaaacaaaaagguugaugaugguuuucuggauguuuggacuuacaaugccgaacuguugguucuauuggaaaaugaaagaacuuuggauuaucacgauucaaaugugaagaaccuauaugagaaaguaagaagccaacuaagaaacaaugccaaggaaauuggaaauggcugcuuugaauuuuaccacaaaugugaugacacgugcauggagagcaucaaaaaugggacuuaugauuauccaaaauacucagaagaagcaaaacuaaccagagaagagauagauggaguaaagcuggaaucaacaaggauuuaucagauuuuggcgaucuauucaacuaucgccaguucauugguacuguuagucucccugggggcaaucaguuucuggaugugcuccaaugggucuuuacagugcagaauauguauuuaa

SEQ ID NO: 30515 - RNA, 1701 nt, Artificial Sequence
  hemagglutinin__InfluenzaA__AAF87275
augaaggcaauacuaguagucuugcuauauacauuuacaaccgcaaaugcagacacauuauguauagguuaccaugcaaauaauucaacugacacuguugacacaguacuagaaaaaaauguaacaguaacacacucuguuaaccuucuagaaaacagacauaacgggaaacuauguaaacuaaaagggguagccccauugcauuuggguaaauguaacauugcuggauggcuccugggaaacccagagugugaauuacuauucacagcaagcucauggucuuacauuguggaaacuucuaauucagacaaugggacauguuacccaggagauuucaucaauuaugaagagcuaagagagcaguugagcucagugucaucauuugaaagauuugagauauuccccaaggcaaauucauggcccaaucaugaaacgaacagaggugugacaucagcguguccuuaugcuggagcaaacagcuucuacagaaacuuaauauggcugguaaaaaaaggaaauucauacccaaaacucagcaaauccuauauuaacaauaaggggaaggaaguccucgugcuauggggcauucaccauccaccuaccaguaaugaucaacaaagucucuaccagaaugcagaugccuauguuuuuguggggucaucaaaauacaacaagaaauucaugccagaaauagcaacaagacccaaagugagaggucaagcagggagaaugaacuauuacuggacacuaauagagccuggagacacaauaacauucgaagcaacuggaaaccuaguggcaccaagauaugccuucgcaauggaaagaggcucuggaucugguauuaucauuucagauacaccaguccacgauuguaaugcgaccugucaaacacccaaaggugcuauaaacaccaaucuuccauuucaaaauauacauccagucacgauuggagaauguccaaaauaugucaaaagcacaagauugagaauggcuacaggauuaaggaauaucccgucuauucaaucuagaggccuguuuggagccauugcuggcuuuauugaggggggauggacaggaaugauagauggaugguaugguuaccaucaccaaaaugagcagggaucaggauaugcagcagaccgaaagagcacacagaaugccauagacgggaucacuaacaaaguaaacucuguuauugaaaagaugaacacacaauucacagcaguggguaaagaauucaaucaccuggaaaaaagaauagagaauuuaaacaaaaagguugaugaugguuuucuggauguuuggacuuacaaugccgaacuguugguucuauuggaaaaugaaagaacuuuggauuaucacgauucaaaugugaagaaccuauaugagaaaguaagaagccaacuaagaaacaaugccaaggaaauuggaaauggcugcuuugaauuuuaccacaaaugugaugacacgugcauggagagcaucaaaaaugggacuuaugauuauccaaaauacucagaagaagcaaaacuaaccagagaagagauagauggaguaaagcuggaaucaacaaggauuuaucagauuuuggcgaucuauucaacuaucgccaguucauugguacuguuagucucccugggggcaaucaguuucuggaugugcuccaaugggucuuuacagugcagaauauguauuuaa

SEQ ID NO: 30516 - RNA, 1701 nt, Artificial Sequence
  hemagglutinin__InfluenzaA__AAF87277
augaaggcaauacuauuagucuugcuauauacauucacagccgcaaaugcagacacauuauguauaggcuaucaugcaaauaauucaacugacacuguugauacaguacuagaaaagaauguaacaguaacacacucuguuaaccuucuagaagacagacauaacggaaaacuauguaagcuaagggggauagccccauugcauuuggguaaauguaacauugcuggauggcuccugggaaacccagaaugugaauuacuauucacagcaagcucauggucuuacauuguggaaacaucuaauucagacaaugggacauguuacccaggagauuucaucaauuaugaagagcuaagagagcaguugagcucagugucaucauuugaaagguuugagauauucccuaaggcaaguucauggcccgaucaugaaacgaacagaggugugacggcagcauguccuuaugcaggagcaaacagcuucuacagaaauuuaauauggcugguaaaaaaaggaaauucauacccaaagcucagcaaauccuauauuaacaauaaagagaaagaaguccucgugcuaugggguauccaccauccaccuaccaguacugaccaacaaagucucuaccagaaugcagaugccuauguuuuuguggggucuucaaaguacaacaagaaauucaagccagaaauagcaucaagacccaaggugagaggucaagcagggaggauggacuauuacuggacacuaguugagccuggagacacaauaacauucgaagcaacuggaaaucuaguggugccaagauaugccuucgcaaugaaaagagguucuggaucugguauuaucauuucagauacaccaguccacgauuguaauacgacuugucaaacacccaaaggugcuauaaacaccagccucccauuucagaauauacauccagucacaauuggagaauguccaaaauaugucaaaaguacaaaauugagaauggcuacaggauuaaggaauaucccgucuauucagucuaggggucuauuuggagccauugcuggcuuuauugaggggggauggacaggaaugauagauggaugguacgguuaucaccaucaaaaugagcagggaucaggauaugcagccgaccgaaagagcacacagaaugccauugacggggucacuaacaaaguaaacucuguuauugaaaagaugaacacacaauucacagcaguggguaaagaauucaaucaccuggaaaaaagaauagaaaauuuaaauaaaaagguugaugaugguuuucuggauguuuggacuuacaaugccgaauuguugguucuauuggaaaaugagagaaccuuggauuaccaugauucaaaugugaagaaccuauaugagaaaguaagaagccagcuaaaaaacaaugccaaggaaauuggaaauggcugcuuugaauuuuaccacaaaugugaugacacgugcauggagagcgucaaaaaugggacuuaugauuaccccaaauacucagaagaaucaaaacuaaacagagaggagauagauggaguaaagcuggaaucaacaaggauuuaccagauuuuggcgauauauucaacugucgccaguucauugauacuguuagucucccugggggcaaucaguuucuggaugugcuccaaugggucuuuacagugcagaauauguauuuaa

SEQ ID NO: 30517 - RNA, 1701 nt, Artificial Sequence
  hemagglutinin__InfluenzaA__AAF87278
augaaggcaauacuauuagucuugcuauauacauucacagccgcaaaugcagacacauuauguauaggcuaucaugcaaauaauucaacugacacuguugauacaguacuagaaaagaauguaacaguaacacacucuguuaaccuucuagaagacagacauaacggaaaacuauguaagcuaagggggauagccccauugcauuuggguaaauguaacauugcuggauggcuccugggaaacccagaaugugaauuacuauucacagcaagcucauggucuuacauuguggaaacaucuaauucagacaaugggacauguuacccaggagauuucaucaauuaugaagagcuaagagagcaguugagcucagugucaucauuugaaagguuugagauauucccuaaggcaaguucauggcccaaucaugaaacgaacagaggugugacggcagcauguccuuaugcaggagcaaacagcuucuacagaaauuuaauauggcugguaaaaaaaggaaauucauacccaaagcucagcaaauccuauauuaacaauaaagagaaagaaguccucgugcuaugggguauccaccauccaccuaccaguacugaccaacaaagucucuaccagaaugcagaugccuauguuuuuguggggucuucaaaguacaacaagaaauucaagccagaaauagcaucaagacccaaggugagaggucaagcagggaggauggacuauuacuggacacuaguugagccuggagacacaauaacauucgaagcaacuggaaaucuaguggugccaagauaugccuucgcaaugaaaagagguucuggaucugguauuaucauuucagauacaccaguccacgauuguaauacgacuugucaaacacccaaaggugcuauaaacaccagccucccauuucagaauauacauccagucacaauuggagaauguccaaaauaugucaaaaguacaaaauugagaauggcuacaggauuaaggaauaucccgucuauucagucuaggggucuauuuggagccauugcuggcuuuauugaggggggauggacaggaaugauagauggaugguacgguuaucaccaucaaaaugagcagggaucaggauaugcagccgaccgaaagagcacacagaaugccauugacggggucacuaacaaaguaaacucuguuauugaaaagaugaacacacaauucacagcaguggguaaagaauucaaucaccuggaaaaaagaauagaaaauuuaaauaaaaagguugaugaugguuuucuggauguuuggacuuacaaugccgaauuguugguucuauuggaaaaugagagagccuuggauuaccaugauucaaaugugaagaaccuauaugagaaaguaagaagccagcuaaaaaacaaugccaaggaaauuggaaauggcugcuuugaauuuuaccacaaaugugaugacacgugcauggagagcgucaaaaaugggacuuaugauuaccccaaauacucagaagaaucaaaacuaaacagagaggagauagauggaguaaagcuggaaucaacaaggauuuaccagauuuuggcgauauauucaacugucgccaguucauugauacuguuagucucccugggggcaaucaguuucuggaugugcuccaaugggucuuuacagugcagaauauguauuuaa

SEQ ID NO: 30518 - RNA, 1701 nt, Artificial Sequence
  hemagglutinin__InfluenzaA__AAF87279
augaaggcaauacuauuagucuugcuauauacauucacagccgcaaaugcagacacauuauguauaggcuaucaugcaaauaauucaacugacacuguugauacaguacuagaaaagaauguaacaguaacacacucuguuaaccuucuagaagacagacauaacggaaaacuauguaagcuaagggggauagccccauugcauuuggguaaauguaacauugcuggauggcuccugggaaacccagaaugugaauuacuauucacagcaagcucauggucuuacauuguggaaacaucuaauucagacaaugggacauguuacccaggagauuucaucaauuaugaagagcuaagagagcaguugagcucagugucaucauuugaaagguuugagauauucccuaaggcaaguucauggcccaaucaugaaacgaacagaggugugacggcagcauguccuuaugcaggagcaaacagcuucuacagaaauuuaauauggcugguaaaaaaaggaaauucauacccaaagcucagcaaauccuauauuaacaauaaagagaaagaaguccucgugcuaugggguauccaccauccaccuaccaguacugaccaacaaagucucuaccagaaugcagaugccuauguuuuuguggggucuucaaaguacaacaagaaauucaagccagaaauagcaucaagacccaaggugagaggucaagcagggaggauggacuauuacuggacacuaguugagccuggagacacaauaacauucgaagcaacuggaaaucuaguggugccaagauaugccuucgcaaugaaaagagguucuggaucugguauuaucauuucagauacaccaguccacgauuguaauacgacuugucaaacacccaaaggugcuauaaacaccagccucccauuucagaauauacauccagucacaauuggagaauguccaaaauaugucaaaaguacaaaauugagaauggcuacaggauuaaggaauaucccgucuauucagucuaggggucuauuuggagccauugcuggcuuuauugaggggggauggacaggaaugauagauggaugguacgguuaucaccaucaaaaugagcagggaucaggauaugcagccgaccgaaagagcacacagaaugccauugacggggucacuaacaaaguaaacucuguuauugaaaagaugaacacacaauucacagcaguggguaaagaauucaaucaccuggaaaaaagaauagaaaauuuaaauaaaaagguugaugaugguuuucuggauguuuggacuuacaaugccgaauuguugguucuauuggaaaaugagagaaccuuggauuaccaugauucaaaugugaagaaccuauaugagaaaguaagaagccagcuaaaaaacaaugccaaggaaauuggaaauggcugcuuugaauuuuaccacaaaugugaugacacgugcauggagagcgucaaaaaugggacuuaugauuaccccaaauacucagaagaaucaaaacuaaacagagaggagauagauggaguaaagcuggaaucaacaaggauuuaccagauuuuggcgauauauucaacugucgccaguucauugauacuguuagucucccugggggcaaucaguuucuggaugugcuccaaugggucuuuacagugcagaauauguauuuaa

SEQ ID NO: 30519 - RNA, 1701 nt, Artificial Sequence
  hemagglutinin__InfluenzaA__AAF87281
augaaggcaauacuaguagucuugcuauauacauuuacaaccgcaaaugcagacacauuauguauagguuaccaugcaaauaauucaacugacacuguugacacaguauuagaaaagaauguaacaguaacacacucuguuaaccuucuagaagacagacauaacgggaaacuauguaaacuaaaagggauagccccauugcauuuggguaaauguaacauugcuggauggcuccugggaaacccagagugugaauuacuauucacagcaagcucauggucuuauauuguggaaacuucuaauucagacaaugggacauguuacccaggagauuucaucaauuaugaagagcuaagagagcaguugagcucagugucaucauuugaaagauuugagauauuccccaaggcaaguucauggcccaaucaugaaacgaacagaggugugacaucagcguguccuuaugcuggagcaaacagcuucuacagaaacuuaauauggcugguaaaaaaaggaaauucauacccaaaacucagcaaauccuauauuaacaauaaggggaagaaaguccucgugcuauggggcauucaccauccaccuaccaguacugaccaacaaagucucuaccagaaugcagaugccuauguuuuuguggggucaucaaaauacaacaagaaauucaugccagaaauagcaacaagacccaaagugagaggucaagcagggagaaugaacuauuacuggacacuaauagagccuggagacacaauaacauucgaagcaacuggaaaucuagugguaccaagauaugccuuugcaauggaaagaggcuauggaucugguauuaucauuucagauacaccaguccaugauuguaauacgacuugucagacacccaaaggugcuauaaacaccagccuuccauuucaaaauauacauccagucacaauuggagaauguccaaaauaugucaaaagcacaaaauugagaauggcuacaggguuaaggaauaucccgucuauacaaucuagaggccuguuuggagccauugcuggcuuuauugaggggggauggacaggaaugauugauggaugguacgguuaucaucaccaaaaugagcagggaucaggguaugcagcagaccgaaagagcacacagaaugccauagacgggaucacuaacaaaguaaacucuguuauugaaaagaugaacacacaauucacagcaguggguaaagaauucaaucaccuggagaaaagaauagagaauuuaaacaaaaagguugaugaugguuuucuggauguuuggacuuacaaugccgaacuguuaguucuauuggaaaaugaaagaacuuuggauuaucacgauucgaaugugaagaaccuauaugagaaaguaaaaagccaacuaaaaaacaaugccaaggaaauuggaaauggcugcuuugaauuuuaccacaaaugugaugacacgugcauggagagcgucaaaaaugggacuuaugauuauccaaaauacucagaagaagcaaaacuaaacagagaagagauagaugggguaaagcuggaaucaacaaggauuuaccagauuuuggcgaucuauucaacuaucgccaguucauugguacuguuagucucccugggggcaaucaguuuuuggaugugcuccaaugggucuuuacagugcagaauauguauuuaa

SEQ ID NO: 30520 - RNA, 1701 nt, Artificial Sequence; identical to SEQ ID NO: 30518
  hemagglutinin__InfluenzaA__AAF87282

SEQ ID NO: 30521 - RNA, 1701 nt, Artificial Sequence
  hemagglutinin__InfluenzaA__AAF87283
augaaggcaauacuaguagucuugcuauaugcauuuacaaccgcaaaugcagacacauuauguauagguuaccaugcaaauaauucaacugacacuguugacacaguacuagaaaagaauguaacaguaacacacucuguuaaccuuuuagaagacagacauaacgggaaacuauguaaacuaaaagggguagccccauugcauuuggguaaauguaacauugcuggauggcuacugggaaacccagagugugaauuacuauucacagcaagcucauggucuuacauuguggaaacuucuaauucagacaaugggacauguuacccaggagauuucaucaauuaugaagagcuaagagagcaguugagcucagugucaucauuugaaagauuugagauauuccccaaggcaaguucauggcccaaucaugaaacgaacagaggugugacaucagcauguccuuauucuggagcaaacagcuucuacagaaacuuaauauggcugguaaaaaaaggaaauucauacccaaaacucagcaaauccuauauuaacaauaaggggaaggaaguucuuguucuauggggcauucaccauccaccuaccaguacugaccaacaaagucucuaccagaaugcagaugccuauguuuuuguggggucaucaaaauacaacaagaaauucaugccagaaauagcaacaagacccaaagugagaggucaagcagggagaaugaacuauuacuggacacuaauugagccuggagacacaauaacauucgaagcaacuggaaaucuaguggcaccaagauaugccuucgcaauggaaagaggcucuggaucugguauuauaauuucagauacaccagucuacgauuguaauacggcuugucaaacacccaaaggugcuauaaacaccagucuuccauuucaaaauauacauccagucacaauuggagaauguccaaaauaugucaaaagcacaaaauugagaauggcuacaggauuaaggaacaucccgucuauucaaucuagaggccuguuuggagccauugcuggcuuuauugaggggggguggacaggaaugauagauggaugguaugguuaucaucaccaaaaugagcaggggucaggauaugcaccagaccgaaagagcacacagaaugccauagacgggaucacuaacaaaguaaacucuguuauugaaaagaugaacacacaauucacagcaguggguaaagaauucaaucacuuggagaaaagaauagagaauuuaaacaaaaagguugaugaugguuuucugaauguuuggacuuacaaugccgaacuguugguucuauuggaaaaugaaagaacuuuggauuaucacgauucaaaugugaagaaccuauaugagaaaguaagaagccaacuaaaaaacaaugccaaggaaauuggaaauggcugcuuugaauuuuaccacaaaugugaugacacgugcauggagagcgucaaaaaugggacuuaugauuauccaaaauacucagaagaagcaagacuaaacagagaagagauagaugggguaaagcuggaaucaacaaggauuuaccagauuuuggcgaucuauucaacuaucgccaguucauugguacuguuagucucccugggggcaaucaguuucuggaugugcuccaaugggucuuuacagugcagaauauguauuuaa

SEQ ID NO: 30522 - RNA, 1701 nt, Artificial Sequence
  hemagglutinin__InfluenzaA__AAF87284
augaaggcaauacuaguagucuugcuauaugcauuuacaaccgcaaaugcagacacauuauguauagguuaccaugcaaauaauucaacugacacuguugacacaguacuagaaaagaauguaacaguaacacacucuguuaaccuuuuagaagacagacauaacgggaaacuauguaaacuaaaagggguagccccauugcauuuggguaaauguaacauugcuggauggcuacugggaaacccagagugugaauuacuauucacagcaagcucauggucuuacauuguggaaacuucuaauucagacaaugggacauguuacccaggagauuucaucaauuaugaagagcuaagagagcaguugagcucagugucaucauuugaaagauuugagauauuccccaaggcaaguucauggcccaaucaugaaacgaacagaggugugacaucagcaugucucuuauucuggagcaaacagcuucuacagaaacuuaauauggcugguaaaaaaggaaauucauacccaaaacucagcaaauccuauauuaacaauaaggggaaggaaguucuuguucuauggggcauucaccauccaccuaccaguacugaccaacaaagucucuaccagaaugcagaugccuauguuuuuguggggucaucaaaauacaacaagaaauucaugccagaaauagcaacaagacccaaagugagaggucaagcagggagaaugaacuauuacuggacacuaauugagccuggagacacaauaacauucgaagcaacuggaaaucuaguggcaccaagauaugccuucgcaauggaaagaggcucuggaucugguauuauaauuucagauacaccagucuacgauuguaauacggcuugucaaacacccaaaggugcuauaaacaccagucuuccauuucaaaauauacauccagucacaauuggagaauguccaaaauaugucaaaagcacaaaauugagaauggcuacaggauuaaggaacaucccgucuauucaaucuagaggccuguuuggagccauugcuggcuuuauugaggggggguggacaggaaugauagauggaugguaugguuaucaucaccaaaaugagcaggggucaggauaugcagcagaccgaaagagcacacagaaugccauagacgggaucacuaacaaaguaaacucuguuauugaaaagaugaacacacaauucacagcaguggguaaagaauucaaucacuuggagaaaagaauagagaauuuaaacaaaaagguugaugaugguuuucugaauguuuggacuuacaaugccgaacuguugguucuauuggaaaaugaaagaacuuuggauuaucacgauucaaaugugaagaaccuauaugagaaaguaagaagccaacuaaaaaacaaugccaaggaaauuggaaauggcugcuuugaauuuuaccacaaaugugaugacacgugcauggagagcgucaaaaaugggacuuaugauuauccaaaauacucagaagaagcaagacuaaacagagaagagauagaugggguaaagcuggaaucaacaaggauuuaccagauuuuggcgaucuauucaacuaucgccaguucauugguacuguuagucucccugggggcaaucaguuucuggaugugcuccaaugggucuuuacagugcagaauauguauuuaa

SEQ ID NO: 30523 - RNA, 1701 nt, Artificial Sequence
  hemagglutinin__InfluenzaA__AAG01749
augagcacuaucauugcuuugagcuacauuuuaugucugguuuucgcucaaaaacuucccggaaaugacaacagcacggcaacgcugugccugggacaccaugcagugccaaacggaacgcuagugaaaacaaucacaaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccucaggucacuaguugccucauccggcacccuggaguuuaccaaugaaggcuucaauuggacuggaguugcucaggauggaacaagcuaugcuugcaaaaggggaucuguuaaaaguuucuuuaguagauugaauugguugcacaaauuagaauacaaauauccagcacugaacguuacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguuagggguaucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauugacaacugcaauucugaaugcaucacuccaaauggaagcauucccaaugaaaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 30524 - RNA, 1701 nt, Artificial Sequence
  hemagglutinin__InfluenzaA__AAG01767
augaauacuaucauugcuuugagcuacauuuuaugucugguuuucgcucaaaaacuucccggaaaugacaacagcacagcaacgcugugccugggacaccaugcagugccaaacggaacccuagugaaaacaaucacgaaugaucaaauugaagugacuaaugcuacugagcugguucagaguuccucaacagguagaauaugcgacaguccucaccgaauccuugauggaaaaaacugcacauugauagaugcucuacuaggagacccucauugcgauggcuuucaaaauaaggaaugggaccuuuuuauugaacgcagcaaagcuuacagcaacuguuacccuuaugaugugccggauuauuccucccuuaggucacuaguugccucaucaggcacccuggaguuuaccaaugaagacuucaauuggacuggggucgcucaggaugggggaagcuauucuugcaaaagggaaucuguuaaaaguuucuuuaguagauugaauugguugcacaaauuagaauacaaauauccagcacugaacgugacuaugccaaacaaugacaaauuugacaaauuguacauuugggggguucaccauccgagcacggacagugaacaaaccagccuauauguucaagcaauagggagagucacagucucuaccaaaaguagccaacaaacuguaaucccgaacaucggguccagacccugggugaggggcaucuccaguagaauaagcaucuauuggacaauaguaaaaccgggagacauacuuuugauuagcagcacagggaaucuaauugcuccucgggguuacuucaaaauacgaaaugggaaaagcucaauaaugaggucagaugcacccauugacaacugcuauucugaaugcaucacuccaaauggaagcauucccaaugacaagccuuuucaaaauguaaacaggaucacauauggggccugucccaaauauguuaagcaaaaaacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaucaagucaacgggaaauugaauagguuaaucgagaaaacgaacgagaaauuccaucaaaucgaaaaagaauuuucagaaguagaagggagaauucaggaccucgagaaauauguugaagacacuaaaauagaucucuggucuuacaacgcggagcuccuuguugcccuggagaaucaacauacaauugaucuaacugacucagaaaugaacaaacuguuugaaaaaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaaaucaggauacaaagauuggauccuauggauuuccuuugccauaucaugcuuuuugcuuuguguuguuuugcuggguuucaucaugugggccugccaaaaaggcaacauuaggugcaacauuugcauuuga

SEQ ID NO: 30525 - RNA, 1701 nt, Artificial Sequence
  hemagglutinin__InfluenzaA__AAG01776
augaauacuaucauugcuuugagcuacauuuuaugucugguuuucgcucaaaaacuucccggaaaugacaacagcacagcaacgcugugccugggacaccaugcagugccaaacggaacccuagugaaaacaaucacgaaugaucaaauugaagugacuaaugcuacugagcugguucagaguuccucaacagguagaauaugcgacaguccucaccgaauccuugauggaaaaaacugcacauugauagaugcucuacuaggagacccucauugcgauggcuuucaaaauaaggaaugggaccuuuuuauugaacgcagcaaagcuuacagcaacuguuacccuuaugaugugccggauuauuccucccuuaggucacuaguugccucaucaggcacccuggaguuuaccaaugaagacuucaauuggacuggggucgcucaggaugggggaagcuauucuugcaaaagggaaucuguuaaaaguuucuuuaguagauugaauugguugcacaaauuagaauacaaauauccagcacugaacgugacuaugccaaacaaugacaaauuugacaaauuguacauuugggggguucaccauccgagcacggacagugaacaaaccagccuauauguucaagcaauagggagagucacagucucuaccaaaaguagccaacaaacuguaaucccgaacaucggguccagacccugggugaggggcaucuccaguagaauaagcaucuauuggacaauaguaaaaccgggagacauacuuuugauuagcagcacagggaaucuaauugcuccucgggguuacuucaaaauacgaaaugggaaaagcucaauaaugaggucagaugcacccauugacaacugcuauucugaaugcaucacuccaaauggaagcauucccaaugacaagccuuuucaaaauguaaacaggaucacauauggggccugucccaaauauguuaagcaaaaaacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaucaagucaacgggaaauugaauugguuaaucgagaaaacgaacgagaaauuccaucaaaucgaaaaagaauuuucagaaguagaagggagaauucaggaccucgagaaauauguugaagacacuaaaauagaucucuggucuuacaacgcggagcuccuuguugcccuggagaaucaacauacaauugaucuaacugacucagaaaugaacaaacuguuugaaaaaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaaaucaggauacaaagauuggauccuauggauuuccuuugccauaucaugcuuuuugcuuuguguuguuuugcuggguuucaucaugugggccugccaaaaaggcaacauuaggugcaacauuugcauuuga

SEQ ID NO: 30526 - RNA, 1701 nt, Artificial Sequence
  hemagglutinin__InfluenzaA__AAG01785
augaagacuaucauugcuuugagcuacauuuuaugucugguuuucgcucaaaaacuucccggaaaugacaacagcacagcaacgcugugccugggacaccaugcagugccaaacggaacccuagugaaaacaaucacgaaugaucaaauugaagugacuaaugcuacugagcugguucagaguuccucaacagguagaauaugcgacaguccucaccgaauccuugauggaaaaaacugcacauugauagaugcucuacuaggagacccucauugcgauggcuuucaaaauaaggaaugggaccuuuuuauugaacgcagcaaagcuuacagcaacuguuacccuuaugaugugccggauuauuccucccuuaggucacuaguugccucaucaggcacccuggaguuuaccaaugaagacuucaauuggacuggggucgcucaggaugggggaagcuauucuugcaaaagggaaucuguuaaaaguuucuuuaguagauugaauugguugcacaaauuagaauacaaauauccagcacugaacgugacuaugccaaacaaugacaaauuugacaaauuguacauuugggggguucaccauccgagcacggacagugaacaaaccagccuauauguucaagcaauagggagagucacagucucuaccaaaaguagccaacaaacuguaaucccgaacaucggguccagacccugggugaggggcaucuccaguagaauaagcaucuauuggacaauaguaaaaccgggagacauacuuuugauuagcagcacagggaaucuaauugcuccucgggguuacuucaaaauacgaaaugggaaaagcucaauaaugaggucagaugcacccauugacaacugcuauucugaaugcaucacuccaaauggaagcauucccaaugacaagccuuuucaaaauguaaacaggaucacauauggggccugucccaaauauguuaagcaaaaaacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaucaagucaacgggaaauugaauagguuaaucgagaaaacgaacgagaaauuccaucaaaucgaaaaagaauuuucagaaguagaagggagaauucaggaccucgagaaauauguugaagacacuaaaauagaucucuggucuuacaacgcggagcuccuuguugcccuggagaaucaacauacaauugaucuaacugacucagaaaugaacaaacuguuugaaaaaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaaaucaggauacaaagauuggauccuauggauuuccuuugccauaucaugcuuuuugcuuuguguuguuuugcuggguuucaucaugugggccugccaaaaaggcaacauuaggugcaacauuugcauuuga

SEQ ID NO: 30527 - RNA, 1701 nt, Artificial Sequence
  hemagglutinin__InfluenzaA__AAK52911
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggaaaaaacugcacacugauagaugcucuauugggagauccucauugugauggcuuccaaaauaaggaaugggaccuuuuuguugaacgcagcacagcuuacagcaacuguuacccuuaugaugugccggauuaugccucccuuaggucacuaguugccucauccggcacccuggaguuuaccaaagaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucggaugcacccauugacaacugcaauucugaaugcauuacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugaaggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaagaaagcaacugagggaaaaugcugaggacaugggcaaugguugcuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucaugcuuuuugcuuuguguuguuuugcugggguucauuaugugggccugccaaaaaggcaacauuaggugcaacauuugcauuuga

SEQ ID NO: 30528 - RNA, 1701 nt, Artificial Sequence
  hemagglutinin__InfluenzaA__AAK52912
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaagaaugggaccuuuuuguugaacgcaccaaagcuuacagcaacuguuacccuuaugaugugccggauuaugccucccuuaggucacuaguugccucauccggcacccuggaguuuaccaaugaaggcuucaauuggacuggagucgcccagaauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaauugcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaaggaagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 30529 - RNA, 1701 nt, Artificial Sequence
  hemagglutinin__InfluenzaA__AAK71687
augaaggcaauacuaguaguccugcuauauacauuuacaaccgcaaaugcagacacauuauguauagguuaucaugcgaacaauucaacugacacuguagacacaguacuagaaaagaauguaacaguaacacacucuguuaaccuucuagaagacaggcauaacgggaaacuauguaaacuaagagggguagccccauugcauuuggguaaauguaacauugcuggcuggcuccugggaaauccagagugugaaucacucuucacagcaagcucaugguccuacauuguggaaacaucuaauucagacaaugggacguguuacccaggagauuucaucaauuaugaagagcuaagagagcaauugagcucagugucaucauuugaaagauuugagauauuccccgagacaaguucauggcccaaucaugacacgaacagaggugugacggcagcauguccucaugcuggagcaaauagcuucuacagaaauuuaauauggcuggccaaaaaaggagauucauacccaaagcucagcaaauccuauauuaacaauaaggggaaggaaguccucgugcuauggggcauucaccauccaccuaccagugccgaccaacaaagucucuaccagaaugcagaugcauauguuuuuguggggucaucaagauacagcaagaaguucaagccagaaauagcaacaagacccaaggugaggggccaagcagggagaaugaacuauuacuggacacuaguagagccuggagacaaaauaacauucgaggcaacuggaaaucuagugguaccgagauaugccuucgcaaugaaaagaaauucugaaucugguauuaucauuucagauauaucaguccacgauuguaauacgacuugucagacacccaagggugcuauaaacaccagccucccauuucagaauauacauccagucacaauuggagaauguccaaaauauguaaaaagcacaaaauugagaauggcuacaggauuaaggaaugucccgucuauucaaucuagaggccuguuuggggccauugccggcuuuauugaggggggauggacaggaaugauagauggaugguacgguuaucaccaucaaaaugagcagggaucaggauaugcagccgaccugaagagcacacagaaugccauugacgggaucacuaacaaaguaaauucuguuaucgaaaagaugaacacacaauucacaguaguagguaaagaguucaaccaccuggaaaaaagaauagagaauuuaaauaaaaagguugaugaugguuuucuggauauuuggacuuacaaugccgaacuguugguucuguuggaaaaugaaagaaccuuggauuaccacgauucaaaugugaagaacuuauaugaaaagguaagaagccagcuaaaaaacaaugccaaggaaauuggaaauggcugcuuugaauuuuaccacaaaugugaugacacgugcauggaaagcgucaaaaaugggacuuaugauuacccaaaauacucagaggaagcaaaacuaaacagagaggaaauagaugggguaaagcuggaaucaacaaggauuuaccagauuuuggcgaucuauucaacugucgccaguucauugguacugguagucucccuggggacaaucaguuucuggaugugcucuaaugggucucuacaguguagaauauguauuuaa

SEQ ID NO: 30530 - RNA, 1707 nt, Artificial Sequence
  hemagglutinin__InfluenzaA__AAS65618
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccucuaauuuugagagauuguaguguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagucucauuaggggugagcucagcauguccauaccagggaaaguccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaaaccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuaguaugccauuccacaauauacacccucucaccaucggggaaugccccaaauaugugaaaucaaacagauuaguccuugcgacugggcucagaaauagcccucaaagagagagaagaagaaaaaagagaggauuauuuggagcuauagcagguuuuauagagggaggauggcagggaaugguagaugguugguauggguaccaccauagcaaugagcaggggaguggguacgcugcagccaaagaauccacucaaaaggcaauagauggagucaccaauaaggucaacucgaucauugacaaaaugaacacucaguuugaggccguuggaagggaauuuaacaacuuagaaaggagaauagagaauuuaaacaagaagauggaagacggguuccuagaugucuggacuuauaaugcugaacuucugguucucauggaaaaugagagaacucuagacuuucacgacucaaaugucaagaaccuuuacgacaagguccgacuacagcuuaaggauaaugcaaaggagcuggguaacgguuguuucgaguucuaucauaaaugugauaaugaauguauggaaaguguaagaaacggaacguaugacuacccgcaguauucagaagaagcaagacuaaaaagagaggaaauaaguggaguaaaauuggaaucaauaggaauuuaccaaauacugucaauuuauucuacaguggcgaguucccuagcacuggcaaucaugguagcuggucuauccuuauggaugugcuccaaugggucguuacaaugcagaauuugcauuuaa

SEQ ID NO: 30531 - RNA, 1704 nt, Artificial Sequence
  hemagglutinin__InfluenzaA__AAT38819
augaauacucaaauuuuggcauucauugcuuguaugcugauuggaacuaaaggagacaaaauaugucuugggcaccaugcuguggcaaaugggacaaaagugaacacacuaacagagaggggaauugaaguagucaaugccacggagacgguggaaacuguaaauauuaagaaaauaugcacucaaggaaaaaggccaacagaucugggacaauguggacuucuaggaacccuaauaggaccuccccaaugcgaucaauuucuggaguuugacgcuaauuugauaauugaacgaagagaaggaaccgaugugugcuaucccgggaaguucacaaaugaagaaucacugaggcagauccuucgagggucaggaggaauugauaaagagucaauggguuucaccuauaguggaauaagaaccaauggggcgacgagugccugcagaagaucagguucuucuuucuaugcggagaugaagugguuacugucgaauucagacaaugcggcauuuccccaaaugacuaagucguauaggaaucccaggaacaaaccagcucugauaaucuggggagugcaucacucuggaucagcuacugagcagaccaaacucuauggaaguggaaacaaguugauaacaguaggaagcucgaaauaccagcaaucauucacuccaaguccgggagcacggccacaagugaauggacaaucaggaaggauugauuuucauuggcuacuccuugaccccaaugacacagugaccuucacuuucaauggggcauucauagccccugacagggcaaguuucuuuagaggagaaucgcuaggaguccagagugauguuccuuuggauucugguugugaaggggauugcuuccacaguggggguacgauagucaguucccugccauuccaaaacaucaacccuagaacaguggggaaaugcccucgauaugucaaacagacaagccuccuuuuggcuacaggaaugagaaacgucccagagaaccccaagcaggccuaccagaaacagaugaccagaggccuuuuuggagcgauugcuggauucauagagaauggaugggaaggucucaucgauggaugguaugguuucagacaucaaaaugcacaaggagaaggaacugcagcugacuacaaaagcacccaaucugcaauagaucagaucacaggcaaauugaaucgucugauugacaaaacaaaccagcaguuugaacugauagacaaugaauucagugagauagaacaacaaaucgggaaugucauuaacuggacacgagacucaaugacugagguauggucguauaaugcugagcuguugguggcaauggagaaucagcauacaauagaucuugcagacucagaaaugaacaaacuuuacgaacgcgucagaaaacaacuaagggaaaaugcugaagaagauggaacuggaugcuuugagauauuccauaagugugaugaucaguguauggagagcauaaggaacaacacuuaugaccauacccaauacaggacagagucauugcagaauagaauacagauagacccagugaaauugaguaguggauacaaagacauaaucuuaugguuuagcuucggggcaucauguuuucuucuucuagccauugcaaugggauugguuuucauuugcauaaagaauggaaacaugcggugcacuauuuguauauag

SEQ ID NO: 30532 - RNA, 1707 nt, Artificial Sequence
  hemagglutinin__InfluenzaA__AAV32636
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccucuaauuuugagagauuguaguguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauucccaaaaguucuugguccagucaugaagccucauuaggggugagcucagcauguccauaccagggaaaguccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaaaccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuaguaugccauuccacaauauacacccucucaccaucggggaaugccccaaauaugugaaaucaaacagauuaguccuugcgacugggcucagaaauagcccucaaagagagagaagaagaaaaaagagaggauuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaacaacuuagaaaggagaauagagaauuuaaacaagaagauggaagacggguuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaacggaacguaugacuacccgcaguauucagaagaagcaagacuaaaaagagaggaaauaaguggaguaaaauuggaaucaauaggaauuuaccaaauacugucaauuuauucuacaguggcgaguucccuagcacuggcaaucaugguagcuggucuauccuuauggaugugcuccaaugggucguuacaaugcagaauuugcauuuaa

SEQ ID NO: 30533 - RNA, 1707 nt, Artificial Sequence
  hemagglutinin__InfluenzaA__AAV34704
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccucuaauuuugagagauuguaguguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauuaggggugagcucagcaugcccauaccagggaaaguccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaagccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuaguaugccauuccacaauauacacccucucaccaucggggaaugccccaaauaugugaaaucaaacagauuaguccuugccacugggcucagaaauagcccucaaagagagagaagaagaaaaaagagaggauuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaacaacuuagaaaggagaauagagaauuuaaacaagaagauggaagacggguuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaacggaacguaugacuacccgcaguauucagaagaagcaagacuaaaaagagaggaaauaaguggaguaaaauuggaaucaauaggaauuuaccaaauacugucaauuuauucuacaguggcgaguucccuagcacuggcaaucaugguagcuggucuauccuuauggaugugcuccaaugggucguuacaaugcagaauuugcauuuaa

SEQ ID NO: 30534 - RNA, 1707 nt, Artificial Sequence
  hemagglutinin__InfluenzaA__AAV65826
auggagaaaauagugcuucuuuuugcaauagucagucuuguuaaaagugaucagauuugcauugguuaccaugcgaacaacucgacagagcagguugacacaauaauggaaaagaacguuacuguuacacaugcccaagacauacuggaaaagacacacaacgggaagcucugcgaucuagauggagugaagccucuaauuuugagagauuguaguguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauuaggggugagcucagcauguccauaccagggaaaguccuccuuuuucagaaaugugguauggcuuaucaaaaagaacaguacauacccaacaauaaagaggagcuacaauaauaccaaccaagaagaucuuuugguacugggggggauucaccauccuaaugaugcggcagagcagacaaagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaaaccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuaguaugccauuccacaauauacacccucucaccaucggggaaugccccaaauaugugaaaucaaacagauuaguccuugcgacugggcucagaaauagcccucaaagagagagaagaagaaaaaagagaggauuauuuggagcuauagcagguuuuauagagggaggauggcagggaaugguagaugguugguauggguaccaccauagcaaugagcaggggaguggcuacgcugcagacaaagaauccacucaaaaggcaauagauggagucaccaauaaggucaacucgaucauugacaaaaugaacacucaguuugaggccguuggaagggaauuuaacaacuuagaaaggagaauagagaauuuaaacaagaagauggaagacggguuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaacggaacguaugacuacccgcaguauucagaagaagcaagacuaaaaagagaggaaauaaguggaguaaaauuggaaucaauaggaauuuaccaaauacugucaauuuauucuacaguggcgaguucccuagcacuggcaaucaugguagcuggucuauccuuauggaugugcuccaaugggucguuacaaugcagaauuugcauuuaa

SEQ ID NO: 30535 - RNA, 1701 nt, Artificial Sequence
  hemagglutinin__InfluenzaA__AAX11505
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcgaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggauuacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcgacauuugcauuuga

SEQ ID NO: 30536 - RNA, 1701 nt, Artificial Sequence
  hemagglutinin__InfluenzaA__AAX11525
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucucuagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauuccgaaugcaucacuccaaauggaagcauucccaaugacaaaccauuucaaaauguaaacaggaucacauauggggccugucccagauauguuaagcaaaacacuuugaaauuggcaacagggaugcgaaauguaccagagaaacaaacuagaggcauauuuggcgcaaucgcgggcuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30537 - RNA, 1701 nt, Artificial Sequence
  hemagglutinin__InfluenzaA__AAX11535
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagaccaaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauuccgaaugcaucacuccaaauggaagcauucccaaugacaaaccauuucaaaauguaaacaggaucacauauggggccugucccagauauguuaagcaaaacacuuugaaauuggcaacagggaugcgaaauguaccagagaaacaaacuagaggcauauuuggcgcaaucgcgggcuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30538 - RNA, 1701 nt, Artificial Sequence
  hemagglutinin__InfluenzaA__AAX11545
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucucuagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauuccgaaugcaucacuccaaauggaagcauucccaaugacaaaccauuucaaaauguaaacaggaucacauauggggccugucccagauauguuaagcaaaacacuuugaaauuggcaacagggaugcgaaauguaccagagaaacaaacuagaggcauauuuggcgcaaucgcgggcuucauagaaaaugguugggagggaaugguggacgguugguacgguuucaggcaucaaaauucugagggcacagggcaagcagcagaucucaaaagcacucaagcagcaaucaaccaaaucaaugggaaacugaauagauuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30539 - RNA, 1701 nt, Artificial Sequence
  hemagglutinin__InfluenzaA__AAX11555
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcgaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccaggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggauuacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcgacauuugcauuuga

SEQ ID NO: 30540 - RNA, 1701 nt, Artificial Sequence
  hemagglutinin__InfluenzaA__AAX11565
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30541 - RNA, 1701 nt, Artificial Sequence
  hemagglutinin__InfluenzaA__AAX11585
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggaugucuccagccaaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaguauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30542 - RNA, 1701 nt, Artificial Sequence; identical to SEQ ID NO: 30536
  hemagglutinin__InfluenzaA__AAX11605

SEQ ID NO: 30543 - RNA, 1701 nt, Artificial Sequence
  hemagglutinin__InfluenzaA__AAX11615
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacugugaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauuccgaaugcaucacuccaaauggaagcauucccaaugacaaaccauuucaaaauguaaacaggaucacauauggggccugucccagauauguuaagcaaaacacuuugaaauuggcaacagggaugcgaaauguaccagagaaacaaacuagaggcauauuuggcgcaaucgcgggcuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacuaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30544 - RNA, 1701 nt, Artificial Sequence
  hemagglutinin__InfluenzaA__AAX11625
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaagcuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30545 - RNA, 1701 nt, Artificial Sequence
  hemagglutinin__InfluenzaA__AAX12731
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagauccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30546 - RNA, 1701 nt, Artificial Sequence
  hemagglutinin__InfluenzaA__AAX12741
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccacaucauguuuuuugcuuuguguugcuuuguugggguucaucaugugggccugccaaaaaggcaacauuaggugcaacauuugcauuuga

SEQ ID NO: 30547 - RNA, 1701 nt, Artificial Sequence
  hemagglutinin__InfluenzaA__AAX12751
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucucuagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauuccgaaugcaucacuccaaauggaagcauucccaaugacaaaccauuucaaaauguaaacaggaucacauauggggccugucccagauauguuaagcaaaacacuuugaaauuggcaacagggaugcgaaauguaccagagaaacaaacuagaggaauauuuggcgcaaucgcgggcuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30548 - RNA, 1701 nt, Artificial Sequence
  hemagglutinin__InfluenzaA__AAX12761
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacuaagggaaaaugcugaggauaugggcaaugguuguuucaaaauauaccacaaaugugacaaugucugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30549 - RNA, 1701 nt, Artificial Sequence
  hemagglutinin__InfluenzaA__AAX12791
augaagacuaucauugcuuugagcuacauuuuaugucugguuuucgcucaaaaacuucccggaaaugacaacagcauggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauugacaaaugcaauucugaaugcaucacuccaaauggaagcauucccaaugacaaaccauuucaaaauguaaacaggaucacauaugggcucugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgaaaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30550 - RNA, 1701 nt, Artificial Sequence
  hemagglutinin__InfluenzaA__AAX12801
augaagacuaucauugcuuugagcuacauuuuaugccugguuuucgcucaaaaauuucccggaaaugacaacagcacggcaacgcugugccuggggcaucaugcagugccaaacggaacgcuagugaaaacaaucacgaaugaccaaauugaaguaacuaaugcuacugagcugguucagaguuccucaacagauagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30551 - RNA, 1701 nt, Artificial Sequence
  hemagglutinin__InfluenzaA__AAX12811
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30552 - RNA, 1701 nt, Artificial Sequence
  hemagglutinin__InfluenzaA__AAX34061
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuagaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauauuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30553 - RNA, 1701 nt, Artificial Sequence
  hemagglutinin__InfluenzaA__AAX35821
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaacuggacuggagucacucagaauggaacaagcucugcuugcaaaaggaaaucuaauaaaaguuucuuuaguagauugaauugguugacccacuuaaaauacaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggacgucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagagacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30554 - RNA, 1701 nt, Artificial Sequence; identical to SEQ ID NO: 30535
  hemagglutinin__InfluenzaA__AAX35831

SEQ ID NO: 30555 - RNA, 1701 nt, Artificial Sequence
  hemagglutinin__InfluenzaA__AAX35851
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagcuuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30556 - RNA, 1701 nt, Artificial Sequence
  hemagglutinin__InfluenzaA__AAX35861
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaauuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagaaucacagucucuaccaaaagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30557 - RNA, 1701 nt, Artificial Sequence
  hemagglutinin__InfluenzaA__AAX35871
augaagacuaucauugcucugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucagcaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcuuugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30558 - RNA, 1701 nt, Artificial Sequence
  hemagglutinin__InfluenzaA__AAX38237
augaagacuaucauugcuuugagcuacauuuuaugccugguuuucgcucaaaaacuucccggaaaugacaacagcacggcgacgcugugccuggggcaccaugcagugccaaacggaacgcuagugaaaacaaucacgaaugaccaaauugaaguaacuaaugcuacugagcugguucagaguuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggaggggaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30559 - RNA, 1701 nt, Artificial Sequence
  hemagglutinin__InfluenzaA__AAX47515
augaaggcuaucauugcuuugagcuacauuuuaugccugguuuucgcucaaaaacuucccggaaaugacaacagcacggcaacgcugugccuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30560 - RNA, 1701 nt, Artificial Sequence
  hemagglutinin__InfluenzaA__AAX47525
augaagacuaucauugcuuugagcuacauuuuaugucugguuuucgcucaaaaacuucccggaaaugacaacagcacggcaacgcugugcauggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccggauacagacaguaaccaaaucagccuauaugcucaagcaucagggagagucacagucucuaccaaaagaagccaacaaacuguaaucccaaauaucggaucuggacccuggguaaggggugucuccagcagaauaagcaucuauuggacaauaguaaaaccgggagacauacuuuuaauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugaaggcacagggcaagcagcagaucuuaaaagcacucaagcagcaaucaaccaaaucaacgggaaacuaaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacacacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30561 - RNA, 1701 nt, Artificial Sequence; identical to SEQ ID NO: 30551
  hemagglutinin__InfluenzaA__AAX47535

SEQ ID NO: 30562 - RNA, 1701 nt, Artificial Sequence
  hemagglutinin__InfluenzaA__AAX56380
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcgaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcgacauuugcauuuga

SEQ ID NO: 30563 - RNA, 1701 nt, Artificial Sequence; identical to SEQ ID NO: 30535
  hemagglutinin__InfluenzaA__AAX56390

SEQ ID NO: 30564 - RNA, 1701 nt, Artificial Sequence
  hemagglutinin__InfluenzaA__AAX56400
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcgaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggauaucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggauuacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcgacauuugcauuuga

SEQ ID NO: 30565 - RNA, 1701 nt, Artificial Sequence; identical to SEQ ID NO: 30562
  hemagglutinin__InfluenzaA__AAX56410

SEQ ID NO: 30566 - RNA, 1701 nt, Artificial Sequence
  hemagglutinin__InfluenzaA__AAX56420
augaagacuaucauugcuuugagcuacuuucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucucuagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauuccgaaugcaucacuccaaaugggagcauucccaaugacaaaccauuucaaaauguaaacaggaucacauauggggccugucccagauauguuaagcaaaacacuuugaaauuggcaacagggaugcgaaauguaccagagaaacaaacuagaggaauauuuggcgcaaucgcgggcuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguuggguuucaucaugugggccugccaaaaaggcaacauuaggugcaacauuugcauuuga

SEQ ID NO: 30567 - RNA, 1701 nt, Artificial Sequence
  hemagglutinin__InfluenzaA__AAX56430
augaagacuaucauugcuuugagcuacauucuaugucugguuuucacucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcgaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggauuacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcgacauuugcauuuga

SEQ ID NO: 30568 - RNA, 1701 nt, Artificial Sequence
  hemagglutinin__InfluenzaA__AAX56440
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaauuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaaugggacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacaaugaccaaaucagccuauaugcucaagcaucagggagagucacagucucuaccaaaagaagccaacaaacuguaaucccgaauauuggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgauuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30569 - RNA, 1701 nt, Artificial Sequence
  hemagglutinin__InfluenzaA__AAX56450
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacaaguagaauaugcgacaguccucaucaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30570 - RNA, 1701 nt, Artificial Sequence
  hemagglutinin__InfluenzaA__AAX56460
augaagacuaucauugcuuugagcuacauuuuaugucugguuuucgcucaaaaacuucccgaaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacacaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaggaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30571 - RNA, 1701 nt, Artificial Sequence
  hemagglutinin__InfluenzaA__AAX56470
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaaugcgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaagcugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaacggaaccuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30572 - RNA, 1701 nt, Artificial Sequence
  hemagglutinin__InfluenzaA__AAX56480
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaggaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30573 - RNA, 1701 nt, Artificial Sequence
  hemagglutinin__InfluenzaA__AAX56510
augaagacuaucauugcuuugagcuacauuuuaugccugguuuucgcucaaaaacuucccggaaaugacaacagcacggcaacgcugugccuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcaaaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30574 - RNA, 1701 nt, Artificial Sequence
  hemagglutinin__InfluenzaA__AAX56520
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaagagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugagguccgaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30575 - RNA, 1701 nt, Artificial Sequence
  hemagglutinin__InfluenzaA__AAX56530
augaaagcaaaacuacuaguucuguugugugcauuuacagcuacauaugcagacacaauauguauaggcuaccaugcgaacaacucaacugacacuguugacacaguacuugagaagaacgugacagugacacacucugucaaccuacuugaggacagucacaacggaaaacuaugccgacuaaaaggaacagccccacuacaauuggguaauugcagcauugccggauggaucuuaggaaauccagaaugcgaaucacuguuuucuaaggaaucauggucuuacauugcagaaacaccaaacccuaaaaauggaacauguuacccaggguauuucgccgacuaugaggaacugagggagcaauugagcucaguaucaucauucgagagauuugaaauauuccccaaggauagcucauggcccaaccacacuguaaccaaaggagugacggcaucaugcucccauaaugggaaaagcagcuuuuacaaaaauuugcuauggcugacggagaagaauggcuuguacccaaaucugagcaaguccuauguaaacaaaaagggaaaagaaguccuugugcuaugggguguucaucacccgucuaacaugggggaccaacgggccaucuaucauaaagaaaaugcuuauguuucuguguugucuucacauuauagcagaagauucaccccagaaauagcaaaaagaccaaaaguaagagaucaagaagggagaauuaacuacuacuggacucugcuggaacccggggacacaauaauauuugaggcaaauggaaaucuaauagcgccgugguacgcuuucgcacugaguagaggcuuugggucaggaaucaucaucucaaacgcaucaaugggugaaugugacgcuaagugucaaacaccccaaggagcuauaaacaguagucuccccuuccagaauguacacccagucacaauaggagaguguccaaaguaugucaggaguacaaaauuaaggaugguuacaggacuaaggaacgucccauccauucaauccagagguuuguuuggagccauugccgguuucauugaaggaggguggacuggaaugauagauggaugguaugguuaucaucaucaaaaugaacaaggaucuggcuaugcugcggaccaaaaaagcacacaaaaugccauuaaugggauuacaaacaaggugaauucuauaaucgagaaaaugaacacucaauucacagcuguaggcaaagaauucaacaaauuagaaaaaaggauggaaaacuuaaauaagaaaguugaugauggauuucuggacauuuggacauauaaugcagaauuguuaguucuccuggaaaaugaaaggacuuuggauuuucaugacuuaaaugugaagaaccuguaugagaaagugaaaaaccaauugaagaauaaugccaaagaaauagggaacggguguuuugaauucuaucacaaguguaacaaugaaugcauggaaagugugaaaaauggaacuuaugacuauccaaaauauuccaaagaaucaaaguuaaacagggaaaaaauugauggagugaaauuggaaucaaugggagucuaucagauucuggcgaucuacucaacugucgccaguucgcuggugcuuuuggucucccugggggcaaucagcuucuggauguguucuaaugggucuuugcaguguagaauaugcaucuga

SEQ ID NO: 30576 - RNA, 1701 nt, Artificial Sequence
  hemagglutinin__InfluenzaA__AAX56550
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30577 - RNA, 1701 nt, Artificial Sequence
  hemagglutinin__InfluenzaA__AAX56560
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacugugaucccgaauaucggaucuagacccaggguaagggaugucuccagccgaauaagcaucuauuggacaauaguaaaaccgggagacauacuuuugaucaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30578 - RNA, 1701 nt, Artificial Sequence
  hemagglutinin__InfluenzaA__AAX56570
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguucuucaacaaguagaauaugcgacaguccucaccaaauccuugauggagaaaauugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcggaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30579 - RNA, 1701 nt, Artificial Sequence
  hemagglutinin__InfluenzaA__AAX56590
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccgaguacagacagugaccaaaucagccuauaugcucaagcaucagggagagucacagucucuaccaagagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugagguccgaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacaggaaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30580 - RNA, 1701 nt, Artificial Sequence
  hemagglutinin__InfluenzaA__AAX56600
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugaucaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30581 - RNA, 1701 nt, Artificial Sequence
  hemagglutinin__InfluenzaA__AAX57644
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugaacugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaguaguaaaaccgggagacauacuuuugauuaacagcacagggaaucuaauugcuccucgggguuacuucaaaaugcgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacggcuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30582 - RNA, 1701 nt, Artificial Sequence; identical to SEQ ID NO: 30535
  hemagglutinin__InfluenzaA__AAX57654

SEQ ID NO: 30583 - RNA, 1701 nt, Artificial Sequence; identical to SEQ ID NO: 30574
  hemagglutinin__InfluenzaA__AAX57664

SEQ ID NO: 30584 - RNA, 1701 nt, Artificial Sequence
  hemagglutinin__InfluenzaA__AAX57684
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30585 - RNA, 1701 nt, Artificial Sequence
  hemagglutinin__InfluenzaA__AAX57694
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccuguccuagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucagaauucugagggcacagggcaagcagcagaucuuaaaagcacucaagcagcaaucaaccaaaucaacgggaaacugaauagguuaaucgaaaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30586 - RNA, 1701 nt, Artificial Sequence
  hemagglutinin__InfluenzaA__AAX57704
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacugacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaaggacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30587 - RNA, 1701 nt, Artificial Sequence
  hemagglutinin__InfluenzaA__AAX57714
augaagacuaucauugcuuugagcuacauuuuaugccugguuuucgcucaaaaacuucccggaaaugacaacagcacggcaacgcuuugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcauugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcgaaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30588 - RNA, 1701 nt, Artificial Sequence
  hemagglutinin__InfluenzaA__AAX57733
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaagagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugagguccgaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30589 - RNA, 1701 nt, Artificial Sequence
  hemagglutinin__InfluenzaA__AAX57734
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacaaguagaauaugcaacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucgucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaagagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugagguccgaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30590 - RNA, 1701 nt, Artificial Sequence
  hemagglutinin__InfluenzaA__AAX57744
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagagaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30591 - RNA, 1701 nt, Artificial Sequence
  hemagglutinin__InfluenzaA__AAX57764
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacgggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30592 - RNA, 1701 nt, Artificial Sequence
  hemagglutinin__InfluenzaA__AAX57774
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggaaggaaugguggacgguugguacgguuucaggcaucaaaacucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30593 - RNA, 1701 nt, Artificial Sequence
  hemagglutinin__InfluenzaA__AAX57784
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaauuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaagagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugagguccgaugcacccauuggcaaaugcaauucugaaugcaucacuccaaauggaagcauccccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30594 - RNA, 1701 nt, Artificial Sequence
  hemagglutinin__InfluenzaA__AAX57794
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcauccauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30595 - RNA, 1701 nt, Artificial Sequence
  hemagglutinin__InfluenzaA__AAX57814
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugaccaugccaaacaaugagaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggaaggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30596 - RNA, 1701 nt, Artificial Sequence
  hemagglutinin__InfluenzaA__AAX57824
augaagacuaucauugcuuugagcuacauuuuauguaugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugaccaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggaaggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30597 - RNA, 1701 nt, Artificial Sequence
  hemagglutinin__InfluenzaA__AAX57834
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcuaguucagaguuccucaacagguagaauaugcgacaguccucaccagauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauacguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30598 - RNA, 1701 nt, Artificial Sequence
  hemagglutinin__InfluenzaA__AAX57844
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccauccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggcaugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30599 - RNA, 1701 nt, Artificial Sequence
  hemagglutinin__InfluenzaA__AAX57864
augaagacuaucauugcuuugagcuacuuucuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccagaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30600 - RNA, 1701 nt, Artificial Sequence
  hemagglutinin__InfluenzaA__AAX57874
augaagacuaucauugcuuugagcuacauuuuaugucugguuuucgcucaaaaacuucccguaaaugacaacagcacggcaacgcugugccugggacaccaugcagugccaaauggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggaaggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30601 - RNA, 1701 nt, Artificial Sequence
  hemagglutinin__InfluenzaA__AAX57884
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucaggaagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaguuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30602 - RNA, 1701 nt, Artificial Sequence
  hemagglutinin__InfluenzaA__AAX57894
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaguccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggaaggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30603 - RNA, 1701 nt, Artificial Sequence
  hemagglutinin__InfluenzaA__AAX57924
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcuuugcuugcaaaaggagaucuauuaaaaguuucuuuaguagauugaauugguugcaccaauuaaaauacaaauauccagcacugaacgugacuaugccaaacaaugaaaaauuugacaaauuguacaucugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30604 - RNA, 1701 nt, Artificial Sequence; identical to SEQ ID NO: 30576
  hemagglutinin__InfluenzaA__AAX57934

SEQ ID NO: 30605 - RNA, 1701 nt, Artificial Sequence
  hemagglutinin__InfluenzaA__AAX57944
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaauuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuggacccuggguaaggggugucuccagcagaauaagcaucuauuggacaauaguaaaaccuggagacauacuuuugauuaacagcacagggaaucuaauugcuccucgggguuacuucaaaauacgaagugggaaaagcucaauaaugcggucagaugcacccauuggcaaauguaauucugaaugcaucacuccaaauggaagcauucccaauggcaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucagaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauaugucgaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauugaacaaccgguuccagaucaaaaguguugagcugaagucaggauacaaagauuggauccuauggauuuccuuugccauaucauguuuuuugcuuuguauuguuuuacugggguucaucaugugggccugccaaaaaggcaacauuaggugcaacauuugcauuuga

SEQ ID NO: 30606 - RNA, 1701 nt, Artificial Sequence
  hemagglutinin__InfluenzaA__AAX76623
augaagacuaucauugcuuugagcuacauucuaugucugguuuucgcucaaaaacuucccggaaaugacaaaagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggauaucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaggucaggauacaaagauuggauccuauggauuuccuuugccauaucauguuuuuugcuuuguguugcuucguugggguucaucaugugggccugccaaaaaggcaacauuaggugcaacauuugcauuuga

SEQ ID NO: 30607 - RNA, 1701 nt, Artificial Sequence
  hemagglutinin__InfluenzaA__AAX76643
augaagacuaucauugcuuugagcuacuuucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcgaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcgacauuugcauuuga

SEQ ID NO: 30608 - RNA, 1701 nt, Artificial Sequence
  hemagglutinin__InfluenzaA__AAX76653
augaagacaaucauugcuuugagcuacuuucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcgaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauuugcucaagcaucaggaagaaucacagucucuaccaaaagaagccaacaaacuguaaucccgaauaucggaucuggacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcgacauuugcauuuga

SEQ ID NO: 30609 - RNA, 1701 nt, Artificial Sequence
  hemagglutinin__InfluenzaA__AAX76663
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccuguccuagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucagaauucugagggcacagggcaagcagcagaucuuaaaagcacucaagcagcaaucaaccaaaucaacgggaaacugaauagguuaaucgaaaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30610 - RNA, 1701 nt, Artificial Sequence
  hemagglutinin__InfluenzaA__AAX76673
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccagaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagagauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuucagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30611 - RNA, 1701 nt, Artificial Sequence
  hemagglutinin__InfluenzaA__AAX76683
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaguaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30612 - RNA, 1701 nt, Artificial Sequence
  hemagglutinin__InfluenzaA__AAX76713
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugaccaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggaaggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaauuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30613 - RNA, 1701 nt, Artificial Sequence
  hemagglutinin__InfluenzaA__AAX76723
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaagaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcauaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggaaggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30614 - RNA, 1701 nt, Artificial Sequence
  hemagglutinin__InfluenzaA__AAX76733
augaagacuaucauagcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagauagaauaugcgacaguccucaccaaauccuugauggaggaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaaaacaaauauccagcacugaacguggcuaugccaaacaaugaaaaauuugacaaauuguacauuugggggguucaccacccggguacagacagugaccaaaucagccuauaugcucaagcaucagggagagucacagucucuaccaaaagaagccaacaaacuguaauuccgaauaucggaucuagacccaggguaagggauauauccagcagaauaagcaucuauuggacaauaguaaaaccgggagacauacuuuugauuaacagcacagggaaucuaauugcuccucgagguuacuucaaaauacgaagugggaaaagcucaauaaugaggucagaugcacccauuggcaaaugcaauucugaaugcaucacuccaaauggaagcauuccuaaugacaaaccauuucaaaauguaaacaggaucacauauggggccugucccagauauguuaagcaaaacacucugaaauuggcaacagggaugcggaaugugccggagaaacaaacuagaggcauauucggugcaaucgcgggcuucauagaaaaugguugggagggaaugguggacgguugguacgguuucaggcaucaaaauuaugagggcacaggacaagcagcagaucuuaaaagcacucaagcagcaaucaaccaaaucaacgggaaacugaauagguuaaucgagaaaacgaacgagaaauuccaccaaauugaaaaagaauucucagaaguagaagggagaauucaggaccucgagaaauauguugaggacacuaaaauagaucucuggucguacaaugcggagcuucuuguugcccuagagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaaaucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30615 - RNA, 1701 nt, Artificial Sequence
  hemagglutinin__InfluenzaA__AAX76743
augaagacuaucauagcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucuaauaaaaguuucuuuaguagauugaauugguugcaccaauuaaaaaacaaauauccagcgcugaacguggcuaugccaaacaaugaaaaauuugacaaauuguacauuugggggguucaccacccgggcacagacagugaccaaaucagccuauaugcucaagcaucagggagagucacagucucuaccaaaagaagccaacaaacuguaaucccgaauaucggaucuagacccaggguaagggauaucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauuccuaaugacaaaccauuucaaaauguaaacaggaucacauauggggccugucccagauauguuaagcaaaacacucugaaauuggcaacagggaugcgaaaugugccagagaaacaaacuagaggcauauucggugcaaucgcgggcuucauagaaaaugguugggagggaaugauggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaccaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacaucaggugcaacauuugcauuuga

SEQ ID NO: 30616 - RNA, 1701 nt, Artificial Sequence
  hemagglutinin__InfluenzaA__AAX76763
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggauaucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuauugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30617 - RNA, 1701 nt, Artificial Sequence
  hemagglutinin__InfluenzaA__AAY18086
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaagaagauccaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucucuagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauuccgaaugcaucacuccaaauggaagcauucccaaugacaaaccauuucaaaauguaaacaggaucacauauggggccugucccagauauguuaagcaaaacacuuugaaauuggcaacagggaugcgaaauguaccagagaaacaaacuagaggcauauuuggcgcaaucgcgggcuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30618 - RNA, 1701 nt, Artificial Sequence
  hemagglutinin__InfluenzaA__AAY18096
augaagacuaucauugcuuugagcugcauucuaugucugguuuucgcucaaaaacuucccggaaaugacaacagcacggcaacgcugugccuugggcaccaugcaguaccaaacggaacgauagugaaaacaaucacgaaugaccaaauugaagucacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcgaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggauuacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcgacauuugcauuuga

SEQ ID NO: 30619 - RNA, 1701 nt, Artificial Sequence
  hemagglutinin__InfluenzaA__AAY18106
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccgggcacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagauuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30620 - RNA, 1701 nt, Artificial Sequence
  hemagglutinin__InfluenzaA__AAY18116
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaagagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugagguccgaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgauuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30621 - RNA, 1701 nt, Artificial Sequence
  hemagglutinin__InfluenzaA__AAY18126
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguccagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaggcuucaacuggacuggagucacucagaauggaacaagcucugcuugcaaaaggaaaucuaauaaaaguuucuuuaguagauugaauugguugacccacuuaaaauacaaauacccagcauugaacgugacuaugccaaacaaugaaaaauuugacaaauuguacauuugggggguucaccacccggguacggacaaugaccaaaucagccuguaugcucaagcaucaggaagaaucacagucucuaccaaaagaagccaacaaacuguaaucccgaauaucggaucuagacccaggguaagggacgucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggaaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30622 - RNA, 1701 nt, Artificial Sequence
  hemagglutinin__InfluenzaA__AAY18136
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuagaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugagugcaucacuccaaauggaagcauucccaaugacaaaccauuucaaaauguaaacaggaucacauauggggccugucccagauauauuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacagggcaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30623 - RNA, 1701 nt, Artificial Sequence; identical to SEQ ID NO: 30592
  hemagglutinin__InfluenzaA__AAY18156

SEQ ID NO: 30624 - RNA, 1701 nt, Artificial Sequence
  hemagglutinin__InfluenzaA__AAY18176
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaaugagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30625 - RNA, 1701 nt, Artificial Sequence; identical to SEQ ID NO: 30576
  hemagglutinin__InfluenzaA__AAY18186

SEQ ID NO: 30626 - RNA, 1701 nt, Artificial Sequence
  hemagglutinin__InfluenzaA__AAY18564
augaagacuaucauugcuuugagcuacauucuaugucugguuuucgcucaaaaacuucccggaaaugacaacagcacggcaacgcuaugccucgggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30627 - RNA, 1701 nt, Artificial Sequence
  hemagglutinin__InfluenzaA__AAY18585
augaagacuaucauugcuuugagcuacauuuuaugucugguuuucgcucaaaaacuucccgaaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaggaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30628 - RNA, 1701 nt, Artificial Sequence; identical to SEQ ID NO: 30540
  hemagglutinin__InfluenzaA__AAY18611

SEQ ID NO: 30629 - RNA, 1701 nt, Artificial Sequence; identical to SEQ ID NO: 30580
  hemagglutinin__InfluenzaA__AAY27843

SEQ ID NO: 30630 - RNA, 1701 nt, Artificial Sequence
  hemagglutinin__InfluenzaA__AAY27853
augaagacuaucauugcuuugagcuacauucuaugucugguuuucgcucaaaaacuucccggaaaugacaacagcacggcaacgcugugccuugggcaccaugcagugccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauuccgaaugcaucacuccaaauggaagcauucccaaugacaaaccauuucaaaauguaaacaggaucacauauggggccugucccagauauguuaagcaaaacacuuugaaauuggcaacagggaugcgaaauguaccagagaaacaaacuagaggcauauuuggcgcaaucgcgggcuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30631 - RNA, 1701 nt, Artificial Sequence
  hemagglutinin__InfluenzaA__AAY27863
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagaucauugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugauaucagaugcacccauuggcaaaugcaauuccgaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30632 - RNA, 1701 nt, Artificial Sequence
  hemagglutinin__InfluenzaA__AAY27959
augaagacuaucauugcuuugagcuacauuuuaugccugguuuucgcucaaaaacuucccggaaaugacaacagcacggcaacgcugugccuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugauguaccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggccuugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuugcauuguuuugcugggguucaucaugugggccugccaaaaaggcaacauuaggugcaacauuugcauuuga

SEQ ID NO: 30633 - RNA, 1701 nt, Artificial Sequence; identical to SEQ ID NO: 30535
  hemagglutinin__InfluenzaA__AAY27994

SEQ ID NO: 30634 - RNA, 1701 nt, Artificial Sequence; identical to SEQ ID NO: 30535
  hemagglutinin__InfluenzaA__AAY28004

SEQ ID NO: 30635 - RNA, 1701 nt, Artificial Sequence; identical to SEQ ID NO: 30535
  hemagglutinin__InfluenzaA__AAY28265

SEQ ID NO: 30636 - RNA, 1701 nt, Artificial Sequence
  hemagglutinin__InfluenzaA__AAY28275
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuucguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggaggucuaauaaaaguuucuuuaguagauugaauugguugcaccaauugaaauacaaauacccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacagacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaguaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaauggcuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30637 - RNA, 1701 nt, Artificial Sequence
  hemagglutinin__InfluenzaA__AAY28285
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaauuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaaugggacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacaaugaccaaaucagccuauaugcucaagcaucagggagagucacagucucuaccaaaagaagccaacaaacuguaaucccgaauauuggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgauuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30638 - RNA, 1701 nt, Artificial Sequence
  hemagglutinin__InfluenzaA__AAY28295
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaaaaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacaaagugggaaaagcucaauaaugagaucagaugcacccauuggcaaaugcaauuccgaaugcaucacuccaaauggaagcauucccaaugacaaaccauuucaaaauguaaacaggaucacauauggggccugucccagauauguuaagcaaaaaacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30639 - RNA, 1701 nt, Artificial Sequence
  hemagglutinin__InfluenzaA__AAY28305
augaaggcuaucauugcuuugagcuacauuuuaugccugguuuucgcucaaaaacuucccggaaaugacaacagcacggcaacgcugugccuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30640 - RNA, 1701 nt, Artificial Sequence
  hemagglutinin__InfluenzaA__AAY28325
augaagacuaucauugcuuugagcuacauuuuaugccugguuuucgcucaaaaacuucccggaaaugacaacagcacggcgacgcugugccuggggcaccaugcagugccaaacggaacgcuagugaaaacaaucacgaaugaccaaauugaaguaacuaaugcuacugagcugguucagaguuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucauagucucuaccaagagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugagguccgaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucgcagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacuaagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30641 - RNA, 1701 nt, Artificial Sequence
  hemagglutinin__InfluenzaA__AAY28335
augaagacuaucauugcuuugagcuacauuuuaugccugguuuccgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacaaguagaauaugcgacaguccucaccaaauccuugauggagaaaacugcacacuaauagaugcucuauuaggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaguagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30642 - RNA, 1701 nt, Artificial Sequence; identical to SEQ ID NO: 30540
  hemagglutinin__InfluenzaA__AAY28345

SEQ ID NO: 30643 - RNA, 1701 nt, Artificial Sequence
  hemagglutinin__InfluenzaA__AAY28355
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguaugguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30644 - RNA, 1701 nt, Artificial Sequence
  hemagglutinin__InfluenzaA__AAY28363
augaagacuaucauugcuuugagcuacauuuuauguaugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccaucauugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30645 - RNA, 1701 nt, Artificial Sequence
  hemagglutinin__InfluenzaA__AAY28375
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcuaguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggcaugucccagauauguuaagcaaaacacucugaaauuggcaacagggaugcggaauguaccagagaaacaaacuagaggcauauucggcgcaaucgcggguuucauagaaaaugguugggaaggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 30646 - RNA, 1701 nt, Artificial Sequence; identical to SEQ ID NO: 30540
  hemagglutinin__InfluenzaA__AAY28385

SEQ ID NO: 30647 - RNA, 1701 nt, Artificial Sequence
  hemagglutinin__InfluenzaA__AAY28395
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuagaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucaaccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauauuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30648 - RNA, 1701 nt, Artificial Sequence
  hemagglutinin__InfluenzaA__AAY28405
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagauuuccucaacagguagaauaugcgacaauccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagucaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaggaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcguuuga

SEQ ID NO: 30649 - RNA, 1701 nt, Artificial Sequence; identical to SEQ ID NO: 30536
  hemagglutinin__InfluenzaA__AAY28486

SEQ ID NO: 30650 - RNA, 1701 nt, Artificial Sequence; identical to SEQ ID NO: 30536
  hemagglutinin__InfluenzaA__AAY28521

SEQ ID NO: 30651 - RNA, 1701 nt, Artificial Sequence
  hemagglutinin__InfluenzaA__AAY28531
augaagacuaucauugcuuugagcuacauucuaugucugguuuucgcucaaaaacuucccggaaaugacaacagcacggcaacgcugugccuugggcaccaugcaguaccaaacggaacgaucgugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcgaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggauuacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcgacauuugcauuuga

SEQ ID NO: 30652 - RNA, 1701 nt, Artificial Sequence
  hemagglutinin__InfluenzaA__AAY28541
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaagagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30653 - RNA, 1701 nt, Artificial Sequence
  hemagglutinin__InfluenzaA__AAY28551
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30654 - RNA, 1701 nt, Artificial Sequence
  hemagglutinin__InfluenzaA__AAY28561
augaagacuaucauugcuuugagcuauauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauuccgaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30655 - RNA, 1701 nt, Artificial Sequence
  hemagglutinin__InfluenzaA__AAY28581
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguugaucgagaaaacgaacgagaaauuccaucaaauugaaaaagaauucucagaaguagaagggagaauucaggaccucgagaaauauguugaggacacuaagauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30656 - RNA, 1701 nt, Artificial Sequence
  hemagglutinin__InfluenzaA__AAY28591
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacuggacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30657 - RNA, 1701 nt, Artificial Sequence
  hemagglutinin__InfluenzaA__AAY28608
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacuguacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaccuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggaaggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30658 - RNA, 1701 nt, Artificial Sequence
  hemagglutinin__InfluenzaA__AAY28618
augaagacuaucauugcuuugagcuacauucuaugucugguuuucgcucaaaagcuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagcagaaugagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagagucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30659 - RNA, 1701 nt, Artificial Sequence; identical to SEQ ID NO: 30551
  hemagglutinin__InfluenzaA__AAY28638

SEQ ID NO: 30660 - RNA, 1701 nt, Artificial Sequence
  hemagglutinin__InfluenzaA__AAY28648
augaagacuaucauugcuuugagcuacauuuuaugccugguuuucgcucaaaaacuucccggaaaugacaacagcacggcaacgcugugccuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30661 - RNA, 1701 nt, Artificial Sequence
  hemagglutinin__InfluenzaA__AAY44610
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcaacaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauuccgaaugcaucacuccaaauggaagcauucccaaugacaaaccauuucaaaauguaaacaggaucacauauggggccugucccagauauguuaagcaaaacacucugaaauuggcaacagggaugcgaaacguaccagagaaacaaacuagaggcauauuuggcgcaaucgcggguuucauagaaaaugguugggagggaaugguggacgguugguaugguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucggaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30662 - RNA, 1701 nt, Artificial Sequence
  hemagglutinin__InfluenzaA__AAY44620
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcgaucaaccaaaucaacgagaaacugaauagguuaaucgagaaaacgaacgagaaauuccaucaaauugaaaaggaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30663 - RNA, 1701 nt, Artificial Sequence
  hemagglutinin__InfluenzaA__AAY44621
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaggguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30664 - RNA, 1701 nt, Artificial Sequence
  hemagglutinin__InfluenzaA__AAY44631
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucagaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30665 - RNA, 1701 nt, Artificial Sequence
  hemagglutinin__InfluenzaA__AAY44641
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaggaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauugguuugcugggguucaucaugugggccugccaaaaaggcaacauuaggugcaacauuugcauuuga

SEQ ID NO: 30666 - RNA, 1701 nt, Artificial Sequence
  hemagglutinin__InfluenzaA__AAY44651
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugaccaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccugggaaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggaaggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugaaggaaaaugcugaggauaugggcaaugguuguuucaaaauauaccacaaaugugacaaugccugcauagggucaaucagaaauggaacuuaugaccaugauguauacagagacgaagcauuaaacaaccgguuucagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30667 - RNA, 1701 nt, Artificial Sequence
  hemagglutinin__InfluenzaA__AAY44755
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuucguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggaggucuaauaaaaguuucuuuaguagauugaauugguugcaccaauugaaauacaaauacccagcacugaacgugacuaugccaaacaaugaaaaauuugacaaauuguacauuugggggguucaccacccgaguacggacagugaccaaaucagccuauaugcucaagcaucagggagagucacagucucuaccaaaagaggccaacagacuguaaucccgaauaucggaucuagacccuggguaaggggugucuccagcauaauaagcaucuauuggacaauaguaaaaccgggagacauacuuuugauuaacagcacagggaaucuaauugcuccucgggguuacuucaaaauacgaagugggaaaagcucaguaaugaggucagaugcauccauugguaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaauggcuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30668 - RNA, 1701 nt, Artificial Sequence
  hemagglutinin__InfluenzaA__AAY44775
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugccacugagcugguucagaguuccucaacagguagaauaugcgacaguccucaccaaauccuugauggagaaaacugcacacuaauagaugcucuauugggagacccucauugugauggcuuccaagauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaccacucugaaauuggcaacagggaugcggaauguaccagagaaacaaacuagaggcauauucggcgcaaucgcggguuucauagaaaaugguugggagggaaugguggaugguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30669 - RNA, 1701 nt, Artificial Sequence; identical to SEQ ID NO: 30576
  hemagglutinin__InfluenzaA__AAY44785

SEQ ID NO: 30670 - RNA, 1701 nt, Artificial Sequence
  hemagglutinin__InfluenzaA__AAY44795
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguacucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30671 - RNA, 1701 nt, Artificial Sequence
  hemagglutinin__InfluenzaA__AAY44796
augaagacuaucauugcuuugagcuacacucuaugucugguuuucgcucaaaaacuucccggaaaugacaacagcacggcaacguugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuagaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauaucaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30672 - RNA, 1701 nt, Artificial Sequence; identical to SEQ ID NO: 30551
  hemagglutinin__InfluenzaA__AAY44896

SEQ ID NO: 30673 - RNA, 1701 nt, Artificial Sequence
  hemagglutinin__InfluenzaA__AAY44906
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucucuagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauuccgaaugcaucacuccaaauggaagcauucccaaugacaaaccauuucaaaauguaaacaggaucacauauggggccugucccagauauguuaagcaaaacacuuugaaauuggcaacagggaugcgaaauguaccagagagacaaacuagaggaauauuuggcgcaaucgcgggcuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuagagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30674 - RNA, 1701 nt, Artificial Sequence
  hemagglutinin__InfluenzaA__AAY46371
augaagacuaucauugcuuugagcuacauuuuaugucugguuuuugcucaaaaacuucccggaaaugacaacagcacggcaacgcugugccugggacaccaugcagugccaaacggaacgcuagugaaaacaaucacgagugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuuugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccggguacggacagugaccaaaccagccuauaugcucaagcaucagggagagucacagucucuaccaaaagaagccaacaaacuguaaucccgaauaucggaucuagacccuggguaagggguguuuccagcagaauaagcaucuauuggacaauagugaaaccgggagacauacuucugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaauggcaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucacagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccacaucauguuuuuugcuuuguguuguuuugcugggguucaucaugugggccugccaaaaaggcaacauuaggugcaacauuugcauuuga

SEQ ID NO: 30675 - RNA, 1701 nt, Artificial Sequence; identical to SEQ ID NO: 30540
  hemagglutinin__InfluenzaA__AAY46381

SEQ ID NO: 30676 - RNA, 1701 nt, Artificial Sequence
  hemagglutinin__InfluenzaA__AAY46391
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguuacaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcauaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggaaggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30677 - RNA, 1701 nt, Artificial Sequence
  hemagglutinin__InfluenzaA__AAY46426
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaauaaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauauaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30678 - RNA, 1701 nt, Artificial Sequence
  hemagglutinin__InfluenzaA__AAY47013
augaagacuaucauugcuuugagcuacauuuuauguuugguuuucgcucaaaaacuucccggaaaugacaacagcacggcaacgcugugccuggggcaucaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucgggucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucaagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30679 - RNA, 1701 nt, Artificial Sequence
  hemagglutinin__InfluenzaA__AAY47023
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacaaguagaauaugcgacaguccucaccaaauccuugauggagaaaacugcacacuaauagaugcucuauugggagacccucauugugauggcuuccaaaauaaggaauggggccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaagcuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30680 - RNA, 1701 nt, Artificial Sequence
  hemagglutinin__InfluenzaA__AAY47052
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguuacaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcauaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30681 - RNA, 1701 nt, Artificial Sequence
  hemagglutinin__InfluenzaA__AAY47075
augaagacuaucauagcuuugagcuacauuuuaugucugguuuucgcucaaaaacuucccggaaaugacaacagcauggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucuaauaaaaguuucuuuaguagauugaauugguugcaccaauuaaaaaacaaauauccagcgcugaacgugacuaugccaaacaaugaaaaauuugacaaauuguacauuugggggguucaccacccgggcacagacagugaccaaaucagccuauaugcucaagcaucagggagagucacagucucuaccaaaagaagccaacaaacuguaaucccgaauaucggaucuagacccaggguaagggauaucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauuccuaaugacaaaccauuucaaaauguaaacaggaucacauauggggccugucccagauauguuaagcaaaacacucugaaauuggcaacagggaugcgaaaugugccagagaaacaaacuagaggcauauucggugcaaucgcgggcuucauagaaaaugguugggagggaaugauggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaccaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacaucaggugcaacauuugcauuuga

SEQ ID NO: 30682 - RNA, 1701 nt, Artificial Sequence
  hemagglutinin__InfluenzaA__AAY47085
augaagacuaucauugcuuugagcuacauucuaugucugguuuucgcucaaaagcuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuagaucacuaguugccucauccggcacacuggaguuuaacaaugaaagcuucaauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaaugucggaucuagacccaggguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguaugguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagagucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30683 - RNA, 1701 nt, Artificial Sequence
  hemagglutinin__InfluenzaA__AAY58320
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggauaucucuagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauuccgaaugcaucacuccaaauggaagcauucccaaugacaaaccauuucaaaauguaaacaggaucacauauggggccugucccagauauguuaagcaaaacacuuugaaauuggcaacagggaugcgaaauguaccagagaaacaaacuagaggcauauuuggcgcaaucgcgggcuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30684 - RNA, 1701 nt, Artificial Sequence
  hemagglutinin__InfluenzaA__AAY59035
augaagacuaucauugcuuugagcuacauuuuaugucugguuuucgcucaaaaacuuaccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaauguaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaucaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaucacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30685 - RNA, 1701 nt, Artificial Sequence
  hemagglutinin__InfluenzaA__AAY64202
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcgaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaaauagaggcauauuuggcgcaaucgcggguuucauagaaaauggcugggagggaaugguggacgguugguacgguuucaggcaucaaaauucugagggcacaggacaagcagcagaucucaaaagcacucaagcagcaauuaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcgacauuugcauuuga

SEQ ID NO: 30686 - RNA, 1701 nt, Artificial Sequence
  hemagglutinin__InfluenzaA__AAY64212
augaagacuaucauugcuuugagcuacauuuuaugucugguuuucgcucaaaaaauucccguaaaugacaacagcacggcaacgcugugccugggacaccaugcagugccaaacggaacgcuagugaaaacaaucacgaaugaacacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacucauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30687 - RNA, 1701 nt, Artificial Sequence
  hemagglutinin__InfluenzaA__AAY64222
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaauagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucuucuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaacaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccagaucaacgggaaacugaauagguuaaucgagaaaacgaacgagaaauuccaucaaauugaaaaagaauucucagaaguagaagggagaauccaggaccucgagaaauauguugaggacacuaaaauagaucucuggucguacaaugcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuagaugcaacauuugcauuuga

SEQ ID NO: 30688 - RNA, 1701 nt, Artificial Sequence
  hemagglutinin__InfluenzaA__AAY64262
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauggggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30689 - RNA, 1701 nt, Artificial Sequence
  hemagglutinin__InfluenzaA__AAY64272
augaagacuaucauugcuuugagcuacauucuaugucugguuuucgcucaaaagcuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagagucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30690 - RNA, 1701 nt, Artificial Sequence
  hemagglutinin__InfluenzaA__AAY64282
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30691 - RNA, 1701 nt, Artificial Sequence
  hemagglutinin__InfluenzaA__AAY64292
augaagacuaucauagcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagauaaaauaugcgacaguccucaccaaauccuugauggaggaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaaaauaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccaggguaagggauauauccagcagaauaagcaucuauuggacaauaguaaaaccgggagacauacuuuugauuaacagcacagggaaucuaauugcuccucgagguuacuucaaaauacgaagugggaaaagcucaauaaugaggucagaugcacccauuggcaaaugcaauucugaaugcaucacuccaaauggaagcauuccuaaugacaaaccauuucaaaauguaaacaggaucacauauggggccugucccagauauguuaagcaaaacacucugaaauuggcaacagggaugcggaaugugccggagaaacaaacuagaggcauauucggugcaaucgcgggcuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaccaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaaaucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30692 - RNA, 1701 nt, Artificial Sequence
  hemagglutinin__InfluenzaA__AAY64302
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgagugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuuugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaagggguguuuccagcagaauaagcaucuauuggacaauagugaaaccgggagacauacuucugauuaacagcacagggaaucuaauugcuccucgggguuacuucaaaauacgaagugggaaaagcucaauaaugaagucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucacagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugucugcauagggucaaucagaaauggaacuuaugaccaugauguauacagagacgaagcauuaaacaaccgguuccagaucaaagguguugagcugaagucaggauacaaagauuggauccuauggauuuccuuugccacaucauguuuuuugcuuuguguuguuuugcugggguucaucaugugggccugccaaaaaggcaacauuaggugcaacauuugcauuuga

SEQ ID NO: 30693 - RNA, 1701 nt, Artificial Sequence; identical to SEQ ID NO: 30687
  hemagglutinin__InfluenzaA__AAY64312

SEQ ID NO: 30694 - RNA, 1701 nt, Artificial Sequence
  hemagglutinin__InfluenzaA__AAY64322
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30695 - RNA, 1701 nt, Artificial Sequence
  hemagglutinin__InfluenzaA__AAY64332
augaagacuaucauugcuuugagcuacauucuaugucugguuuucacucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcgacauuugcauuuga

SEQ ID NO: 30696 - RNA, 1701 nt, Artificial Sequence
  hemagglutinin__InfluenzaA__AAY64342
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugaaggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccacaucauguuuuuugcuuuguguuguuuugcugggguucaucaugugggccugccaaaaaggcaacauuaggugcaacauuugcauuuga

SEQ ID NO: 30697 - RNA, 1701 nt, Artificial Sequence
  hemagglutinin__InfluenzaA__AAY64352
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauuccgaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30698 - RNA, 1701 nt, Artificial Sequence
  hemagglutinin__InfluenzaA__AAY64362
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuagaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggauaucuccagccgaauaagcaucuauuggacaauaguaaaaccgggagacauacuuuugauuaauagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauauuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30699 - RNA, 1701 nt, Artificial Sequence
  hemagglutinin__InfluenzaA__AAY64382
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauagugaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacaggaaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30700 - RNA, 1701 nt, Artificial Sequence
  hemagglutinin__InfluenzaA__AAY64392
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuagcagauugaauugguugacccacuuaaaauacaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcuaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacaucugcauuuga

SEQ ID NO: 30701 - RNA, 1701 nt, Artificial Sequence; identical to SEQ ID NO: 30692
  hemagglutinin__InfluenzaA__AAY64402

SEQ ID NO: 30702 - RNA, 1701 nt, Artificial Sequence
  hemagglutinin__InfluenzaA__AAY98037
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaauuaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30703 - RNA, 1701 nt, Artificial Sequence; identical to SEQ ID NO: 30694
  hemagglutinin__InfluenzaA__AAY98047

SEQ ID NO: 30704 - RNA, 1701 nt, Artificial Sequence; identical to SEQ ID NO: 30551
  hemagglutinin__InfluenzaA__AAY98057

SEQ ID NO: 30705 - RNA, 1701 nt, Artificial Sequence
  hemagglutinin__InfluenzaA__AAY98067
augaagacuaucauugcuuugagcuacauuuuaugucugguuuucgcucaagaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgaaaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30706 - RNA, 1701 nt, Artificial Sequence
  hemagglutinin__InfluenzaA__AAY98077
augaagacuaucauugcucugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucagcaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaauugagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaucaacauacaauugaucuaacugacucagaaaugaacaaacuguuugaaagaacaaagaagcaacugagggaaaaugcugaggauaugggcaacgguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30707 - RNA, 1701 nt, Artificial Sequence
  hemagglutinin__InfluenzaA__AAY98087
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaacuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30708 - RNA, 1701 nt, Artificial Sequence; identical to SEQ ID NO: 30702
  hemagglutinin__InfluenzaA__AAY98097

SEQ ID NO: 30709 - RNA, 1701 nt, Artificial Sequence
  hemagglutinin__InfluenzaA__AAY98107
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaacucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30710 - RNA, 1701 nt, Artificial Sequence
  hemagglutinin__InfluenzaA__AAY98117
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggggaucuaauaaaaguuucuuuaguagauugaauugguugcaccaauuaaaauacaaauauccagcacugaacgugacuaugccaaacaaugaaaaauuugaaaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30711 - RNA, 1701 nt, Artificial Sequence
  hemagglutinin__InfluenzaA__AAY98147
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30712 - RNA, 1701 nt, Artificial Sequence; identical to SEQ ID NO: 30694
  hemagglutinin__InfluenzaA__AAY98157

SEQ ID NO: 30713 - RNA, 1701 nt, Artificial Sequence
  hemagglutinin__InfluenzaA__AAY98167
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguucaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuacccaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30714 - RNA, 1701 nt, Artificial Sequence
  hemagglutinin__InfluenzaA__AAY98177
augaagacuaucauugcuuugagcuacauucuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggggcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30715 - RNA, 1701 nt, Artificial Sequence
  hemagglutinin__InfluenzaA__AAY98195
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30716 - RNA, 1701 nt, Artificial Sequence
  hemagglutinin__InfluenzaA__AAY98207
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguucaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30717 - RNA, 1701 nt, Artificial Sequence; identical to SEQ ID NO: 30692
  hemagglutinin__InfluenzaA__AAY98217

SEQ ID NO: 30718 - RNA, 1701 nt, Artificial Sequence; identical to SEQ ID NO: 30709
  hemagglutinin__InfluenzaA__AAY98227

SEQ ID NO: 30719 - RNA, 1701 nt, Artificial Sequence; identical to SEQ ID NO: 30694
  hemagglutinin__InfluenzaA__AAY98237

SEQ ID NO: 30720 - RNA, 1701 nt, Artificial Sequence
  hemagglutinin__InfluenzaA__AAY98247
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauauuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30721 - RNA, 1701 nt, Artificial Sequence
  hemagglutinin__InfluenzaA__AAY98319
augaagacuaucauugcuuugagcuacauucuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30722 - RNA, 1701 nt, Artificial Sequence
  hemagglutinin__InfluenzaA__AAY98329
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcauuagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcggguuucauagaaaaugguugggagggaaugguggacgguugguacgguuucaggcaucuaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30723 - RNA, 1701 nt, Artificial Sequence; identical to SEQ ID NO: 30694
  hemagglutinin__InfluenzaA__AAY98339

SEQ ID NO: 30724 - RNA, 1701 nt, Artificial Sequence; identical to SEQ ID NO: 30694
  hemagglutinin__InfluenzaA__AAY98353

SEQ ID NO: 30725 - RNA, 1701 nt, Artificial Sequence
  hemagglutinin__InfluenzaA__AAY98366
augaagacuaucauugcuuugagcuacauuuuaugccugguuuucgcucaaaaacuucccggaaaugacaacagcacggcaacgcugugccugggacaccaugcagugccaaacggaacgcuagugaaaacaaucacgagugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuuugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccggguacggacagugaccaaaccagccuauaugcucaagcaucagggagagucacagucucuaccaaaagaagccaacaaacuguaaucccgaauaucggaucuagacccuggguaagggguguuuccagcagaauaagcaucuauuggacaauagugaaaccgggagacauacuucugaucaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucacagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccacaucauguuuuuugcuuuguguuguuuugcugggguucaucaugugggccugccaaaaaggcaacauuaggugcaacauuugcauuuga

SEQ ID NO: 30726 - RNA, 1701 nt, Artificial Sequence
  hemagglutinin__InfluenzaA__AAY98376
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugugacaguccucaccaaauccuugauggagaaaacugcacacuaauagaugcucuauugggagauccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacaguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaaugagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30727 - RNA, 1701 nt, Artificial Sequence
  hemagglutinin__InfluenzaA__AAY98386
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuaccgagcugguucagaguuccucaacagguagaauaugcgacaguccucaccaaauccuugauggaggaaacugcacacuaauagaugcucuauugggagacccucauugugauggcuuccaaaauaaggaaugggaccuuuuuguugaacgcagcaaagucuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaucucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuuuaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30728 - RNA, 1701 nt, Artificial Sequence; identical to SEQ ID NO: 30694
  hemagglutinin__InfluenzaA__AAY98396

SEQ ID NO: 30729 - RNA, 1701 nt, Artificial Sequence
  hemagglutinin__InfluenzaA__AAY98406
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccccaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauucuauggauuuccuuugccauaucauguuuuuugcuuuguguuguuuugcugggguucaucaugugggccugccaaaaaggcaacauuaggugcaacauuugcauuuga

SEQ ID NO: 30730 - RNA, 1701 nt, Artificial Sequence
  hemagglutinin__InfluenzaA__AAZ32946
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcgaagccuacagcaacuguuacccuuaugaugugccggauuaugccucccuuaggucacuaauugccucauccggcacacuggaguuuaccaaugaaagcuucaauuggacuggagucacucagaauggaacaagcucugcuugcaaaaggagaucuaauaaaaguuucuuuaguagauugaauugguugacccauuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagaccaaggguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauauaaacaggaucacauaugggaccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaauugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 30731 - RNA, 1701 nt, Artificial Sequence
  hemagglutinin__InfluenzaA__AAZ32949
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcgaagccuacagcaacuguuacccuuaugaugugccggauuaugccucccuuaggucacuaauugccucauccggcacacuggaguuuaccaaugaaagcuucaauuggacuggagucacucagaauggaacaagcucugcuugcaaaaggagaucuaauaaaaguuucuuuaguagauugaauugguugacccauuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagaccaaggguaagggauaucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauauaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaauugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 30732 - RNA, 1701 nt, Artificial Sequence
  hemagglutinin__InfluenzaA__AAZ32950
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcgaagccuacagcaacuguuacccuuaugaugugccggauuaugccucccuuaggucacuaauugccucauccggcacacuggaguuuaccaaugaaagcuucaauuggacuggagucacucagaauggaacaagcucugcuugcaaaaggagaucuaauaaaaguuucuuuaguagauugaauugguugacccauuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagaccaaggguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauauaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaaggagcaauugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 30733 - RNA, 1701 nt, Artificial Sequence
  hemagglutinin__InfluenzaA__AAZ32951
augaagacuaucauugcuuugagcuacauuuuaugucugguuuucgcucaaaaaauucccggaaaugacaacagcacggcaacgcugugccuugggcaccaugcaguaccaaauggaacgcuagugaaaacaaucacgaaugaccaaauugaagugacuaaugcuacugagcugguucagaguuccucaacagguggaauaugcgacaguccucaucagauccuugauggagaaaacugcacacuaauagaugcucuauugggagacccucauugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuaguagauugaauugguugcaccaauuaaaauacaaauacccagcauugaacguggcuaugccaaacaaugaaaaauuugacaaauuguacauuugggggguucaccacccggguacggacagugaccaaaucagccuauaugcucaagcaucagggagaaucacagucucuaccaaaagaagccaacaaacuguaaucccgaauaucggaucuagacccaggguaagggauaucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuugcugggguucaucaugugggccugccaaaaaggcaacauuaggugcaacauuugcauuuga

SEQ ID NO: 30734 - RNA, 1701 nt, Artificial Sequence
  hemagglutinin__InfluenzaA__AAZ32952
augaagacuaucauugcuuugagcuacauuuuaugucugguuuucgcucaaaaaauucccggaaaugacaacagcacggcaacgcugugccuugggcaccaugcaguaccaaauggaacgcuagugaaaacaaucacgaaugaccaaauugaagugacuaaugcuacugagcugguucagaguuccucaacagguggaauaugcgacaguccucaucagauccuugauggagaaaacugcacacuaauagaugcucuauugggagacccucauugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuaguagauugaauugguugcaccaauuaaaauacaaauacccagcauugaacguggcuaugccaaacaaugaaaaauuugacaaauuguacauuugggggguucaccacccggguacggacagugaccaaaucagccuauaugcucaagcaucagggagaaucacagucucuaccaaaagaagccaacaaacuguaaucccgaauaucggaucuagacccaggguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaagaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuugcugggguucaucaugugggccugccaaaaaggcaacauuaggugcaacauuugcauuuga

SEQ ID NO: 30735 - RNA, 1701 nt, Artificial Sequence
  hemagglutinin__InfluenzaA__AAZ32953
augaagacuaucauugcuuugagcuacauuuuaugucugguuuucgcucaaaaaauucccggaaaugacaacagcacggcaacgcugugccuugggcaccaugcaguaccaaauggaacgcuagugaaaacaaucacgaaugaccaaauugaagugacuaaugcuacugagcugguucagaguuccucaacagguggaauaugcgacaguccucaucagauccuugauggagaaaacugcacacuaauagaugcucuauugggagacccucauugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuaguagauugaauugguugcaccaauuaaaauacaaauacccagcauugaacguggcuaugccaaacaaugaaaaauuugacaaauuguacauuugggggguucaccacccggguacggacagugaccaaaucagccuauaugcucaagcaucagggagaaucacagucucuaccaaaagaagccaacaaacuguaaucccgaauaucggaucuagacccaggguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuugcugggguucaucaugugggccugccaaaaaggcaacauuaggugcaacauuugcauuuga

SEQ ID NO: 30736 - RNA, 1701 nt, Artificial Sequence
  hemagglutinin__InfluenzaA__AAZ38462
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgagugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuuugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucacuacccggguacggacagugaccaaaccagccuauaugcucaagcaucagggagagucacagucucuaccaaaagaagccaacaaacuguaaucccgaauaucggaucuagacccuggguaagggguguuuccagcagaauaagcaucuauuggacaauagugaaaccgggagacauacuucugauuaacagcacagggaaucuaauugccccucgggguuacuucaaaauacgaagugggaaaagcucaauaaugaggucagaugcacccauuggcaaaugcaauucugaaugcaucacuccaaauggaagcauucccaauggcaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucacagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaggcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccacaucauguuuuuugcuuuguguuguuuugcugggguucaucaugugggccugccaaaaaggcaacauuaggugcaacauuugcauuuga

SEQ ID NO: 30737 - RNA, 1701 nt, Artificial Sequence
  hemagglutinin__InfluenzaA__AAZ38473
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgagugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuuuacuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccaaguacggacagugaccaaaccagccuauaugcucaagcaucagggagagucacagucucuaccaaaagaagccaacaaacuguaaucccgaauaucggaucuagacccuggguaagggguguuuccagcagaauaagcaucuauuggacaauagugaaaccgggagacauacuucugauuaacagcacagggaaucuaauugcuccucgggguuacuucaaaauacgaagugggaaaagcucaauaaugaagucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucacagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugucugcauagggucaaucagaaauggaacuuaugaccaugauguauacagagacgaagcauuaaacaaccgguuccagaucaaagguguugagcugaagucaggauacaaagauuggauccuauggauuuccuuugccacaucauguuuuuugcuuuguguuguuuugcugggguucaucaugugggccugccaaaaaggcaacauuaggugcaacauuugcauuuga

SEQ ID NO: 30738 - RNA, 1701 nt, Artificial Sequence; identical to SEQ ID NO: 30694
  hemagglutinin__InfluenzaA__AAZ38484

SEQ ID NO: 30739 - RNA, 1701 nt, Artificial Sequence
  hemagglutinin__InfluenzaA__AAZ38495
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaagaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcaaaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30740 - RNA, 1701 nt, Artificial Sequence
  hemagglutinin__InfluenzaA__AAZ38517
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaauuagccuauaugcucaagcuucaggaagaaucacagucucuaccaaaagaagccaacaaacuguaaucccgaauaucggaucuagacccaggguaagggauauccccagcagaauaagcauauauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaauguaacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 30741 - RNA, 1701 nt, Artificial Sequence
  hemagglutinin__InfluenzaA__AAZ38539
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcaaaauaagcaucuauuggacaauaguaaaaccgggagacauauuuuugauuaacagcacagggaaucuaauugcuccucgggguuauuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaggaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30742 - RNA, 1701 nt, Artificial Sequence; identical to SEQ ID NO: 30729
  hemagglutinin__InfluenzaA__AAZ38561

SEQ ID NO: 30743 - RNA, 1701 nt, Artificial Sequence
  hemagglutinin__InfluenzaA__AAZ38583
augaagacuaucauugcuuugagcuacauccuaugucugguuuucgcucaaaaaauucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacgaacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggaucauauggauuuccuuugccauaucauguuuuuugcuuuguguugcuuuguugggguucaucaugugggccugccaaaaaggcaacauuaggugcaacauuugcauuuga

SEQ ID NO: 30744 - RNA, 1701 nt, Artificial Sequence
  hemagglutinin__InfluenzaA__AAZ38594
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30745 - RNA, 1701 nt, Artificial Sequence
  hemagglutinin__InfluenzaA__AAZ38605
augaagacuaucauugcuuugagcuacauucuaugucugguuuuuacucaaaaacuucccggaaaugacaacagcacggcaacgcugugccuugggcaccaugcaguaccaaacggaacgauagugaaaacaaucacgaaugaccaaauugaagucacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugcaucccuuagaucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaacuguacauuugggggguucaccacccggguacggacaaugaccaaaucagccuauaugcucaagcaucaggaagaaucacagucuccaccaaaagaagccaacaaacuguaaucccgaguaucgggucuagacccaggauaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguggcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugaguugaagucaggauacaaagauuggauccuauggauuucuuuugccauaucauguuuuuugcuuuguguugcuuuguugggguucaucaugugggccugccaaaaaggcaacauuaggugcaacauuugcauuuga

SEQ ID NO: 30746 - RNA, 1698 nt, Artificial Sequence
  hemagglutinin__InfluenzaA__AAZ38627
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaaggaagcucauggcccaaccacaccguaaccggaguaucagcaucaugcucccauaaugggaaaagcaguuuuuacagaaauuugcuauggcugacgggaaagaaugguuuguacccaaaccugagcauguccuauguaaacaacaaagagaaagaaguccuugugcuaugggguguucaucacccaccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggauggcuacaggacuaaggaacaucccuuccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaauaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaacggaacuuaugacuauccaaaauauuccgaagaaucaaaguuaaacagggagaaaauugauggaguaaaauuggaaucaaugggagucuaucagauucuggcaaucuacucaacugucgccaguucccugguucuuuuggucucccugggggcaaucagcuucuggauguguuccaaugggucuuugcaguguagaauaugcaucuga

SEQ ID NO: 30747 - RNA, 1701 nt, Artificial Sequence
  hemagglutinin__InfluenzaA__AAZ38638
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggauacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30748 - RNA, 1701 nt, Artificial Sequence
  hemagglutinin__InfluenzaA__AAZ38650
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacccugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30749 - RNA, 1701 nt, Artificial Sequence
  hemagglutinin__InfluenzaA__AAZ43370
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugauggaaaaaacugcacacugauagaugcucuauugggagacccucauugugauggcuuccaaaaugagaaaugggaccuuuuuauugaacgcagcaaagcuuucagcaacuguuacccuuaugaugugccggauuaugccucccuuaggucacuaguugccucaucaggcacccuggaguuuaucaaugaaggcuucaauuggacuggagucacucagagugggggaagcuaugcuugcaaaaggggaucuguuaaaaguuucuucaguagauugaauugguuguacgaaucagaauacaaauauccagcgcugaacgugacuaugccaaacaauggcaaauuugacaaacuguacauuugggggguucaccacccgagcacggaaaaagaacaaaccaaccuauauguucgagcaucagggagagucacagucucuaccaagagaagccagcaaacuguaaucccgaauaucgggucuagacccuggguaaggggucuguccaguagaauaagcaucuauuggacaauaguaaaaccgggagacauacuguugauuaauagcacugggaaccuaauugcuccucgggguuacuucaaaauacgcacugggaaaagcucaauaaugaggucagaugcaccuauuggcaccugcaguucugaaugcaucacuccaaauggaagcauucccaaugacaaacccuuucaaaauguaaacaagaucacauauggggcaugucccagguauguuaagcaaaacacucugaaauuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacggaaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 30750 - RNA, 1701 nt, Artificial Sequence
  hemagglutinin__InfluenzaA__AAZ43394
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuagaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauauuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggacaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30751 - RNA, 1701 nt, Artificial Sequence
  hemagglutinin__InfluenzaA__AAZ43405
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 30752 - RNA, 1701 nt, Artificial Sequence; identical to SEQ ID NO: 30551
  hemagglutinin__InfluenzaA__AAZ74352

SEQ ID NO: 30753 - RNA, 1701 nt, Artificial Sequence
  hemagglutinin__InfluenzaA__AAZ74363
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcaguaaagccuacagcaacuguuacccuuaugaugugccggauuaugccucccuuaggucacuaguugccucauccggcacccuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaacuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacccaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30754 - RNA, 1698 nt, Artificial Sequence
  hemagglutinin__InfluenzaA__AAZ74374
augaaaguaaaacuacugauccuguuauguacauuuacagcuacauaugcagacacaauauguauaggcuaccaugccaacaacucaaccgacacuguugacacaguacuugagaaaaaugugacagugacacacucugucaaccuacuugaggacagucacaauggaaaacugugccuacuaaaaggaauagccccccuacaauuggguaauugcagcguugccggauggaucuuaggaaacccagaaugcgaauuacugauuuccaaggaaucaugguccuacauuguagaaacaccaaauccugagaauggagcauguuacccaggguauuucgccgacuaugaggagcuaagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuguggcugacggggaagaaugguuuguacccaaaccugagcaaguccuaugcaaacaacaaagagaaagaaguccuuauacuaugggguguucaucacccgccuaacauaggggaccaaaggacccucuaucacacagaaaaugcuuaugucucuguagugucuucacauuauggcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacauccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacguuuggacauauaaugcagaauuguugguucuacuggaaaaugaaaggacuuuggauuuccacgacuccaaugugaagaaucuguacgagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaauugauggagugaaauuggacucaaugggggucuaucagauucuggcgaucuacucaacugucgccaguucccugguucuuuuggucucccugggggcaaucagcuucuggauguguuccaaugggucuuugcaguguagaauaugcaucuga

SEQ ID NO: 30755 - RNA, 1701 nt, Artificial Sequence
  hemagglutinin__InfluenzaA__AAZ74397
augaauacuaucauugcuuugagcuacauuuuaugucugguuuuugcucaaaaacuucccggaaaugacaacagcacggcaacgcugugccugggacaccaugcagugccaaacggaacgcuagugaaaacaaucacgagugaccaaauugaagugacuaaugcuacugagcugguucagaguuccucaacagguagaauaugcgacaguccucaccgaauccuugauggagaaaacugcacacugauagaugcucuauugggagacccucuuugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuuugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccggguacggacagugaccaaaccagccuauaugcucaagcaucagggagagucacagucucuaccaaaagaagccaacaaacuguaaucccgaauaucggaucuagacccuggguaagggguguuuccagcagaauaagcaucuauuggacaauagugaaaccgggagacauacuucugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaauggcaaaccauuucaaaauguaaacaggaucacauauggggccugucccagauauguuaagcaaaacacucugaaauuggcaacagggaugcggaauguaccagagaaacaaacuagaggcauauucggugcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucacagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccacaucauguuuuuugcuuuguguuguuuugcugggguucaucaugugggccugccaaaaaggcaacauuaggugcaacauuugcauuuga

SEQ ID NO: 30756 - RNA, 1701 nt, Artificial Sequence
  hemagglutinin__InfluenzaA__AAZ74408
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuauaaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30757 - RNA, 1701 nt, Artificial Sequence; identical to SEQ ID NO: 30694
  hemagglutinin__InfluenzaA__AAZ74430

SEQ ID NO: 30758 - RNA, 1701 nt, Artificial Sequence
  hemagglutinin__InfluenzaA__AAZ74441
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacugcuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguaugguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30759 - RNA, 1701 nt, Artificial Sequence
  hemagglutinin__InfluenzaA__AAZ74452
augaagacuaucauugcuuugagcuacauucuaugucugguuuucgcucaaaaacuucccggaaacgacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuauugaacgcagcaaagccuacagcaacuguuacccuuaugaugugccggauuaugccucccuuaggucacuaguugccucauccggcacacuggaauuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacaccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaaacaacugagggaaaaugcugaggauaugggcaaugguuguuucaaaauauaccacaaaugugacaaugccugcauagggucaaucagaaauggaacuuaugaccaugauguauacagagaugaagcauugaacaaccgguuccagaucaaagguguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30760 - RNA, 1701 nt, Artificial Sequence
  hemagglutinin__InfluenzaA__AAZ74463
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuuguaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaauuagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 30761 - RNA, 1701 nt, Artificial Sequence
  hemagglutinin__InfluenzaA__AAZ74474
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacugguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaagagaucuaauaacaguuucuuuaguagauugaauugguugacccacuuaaaauucaaauacccagcacugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucggaaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30762 - RNA, 1701 nt, Artificial Sequence
  hemagglutinin__InfluenzaA__AAZ74485
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuauugaacgcagcaaagccuacagcaacuguuacccuuaugaugugccggauuaugccucccuuaggucacuaguugccucauccggcacacuggaauuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauacguugaggacacuaaaauagaucucuggucauacaacgcagagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaggcauugaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30763 - RNA, 1701 nt, Artificial Sequence
  hemagglutinin__InfluenzaA__AAZ74496
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcaugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaauuagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 30764 - RNA, 1701 nt, Artificial Sequence
  hemagglutinin__InfluenzaA__AAZ74507
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuauugaacgcagcaaagccuacagcaacuguuacccuuaugaugugccggauuaugccucccuuaggucacuaguugccucauccggcacacuggaauuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaggcauugaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30765 - RNA, 1701 nt, Artificial Sequence; identical to SEQ ID NO: 30763
  hemagglutinin__InfluenzaA__AAZ74518

SEQ ID NO: 30766 - RNA, 1701 nt, Artificial Sequence
  hemagglutinin__InfluenzaA__AAZ74529
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuauugaacgcagcaaagccuacagcaacuguuacccuuaugaugugccggauuaugccucccuuaggucacuaguugccucauccggcacacuggaauuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaagcaaacuagaggcauauuuggcgcaaucgcggguuucauagaaaaugguugggagggaaugguggaugguugguacggcuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaggcauugaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30767 - RNA, 1701 nt, Artificial Sequence
  hemagglutinin__InfluenzaA__AAZ74551
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaauugcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacacuugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgauuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30768 - RNA, 1701 nt, Artificial Sequence
  hemagglutinin__InfluenzaA__AAZ74562
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaggugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguuacaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30769 - RNA, 1701 nt, Artificial Sequence
  hemagglutinin__InfluenzaA__AAZ74573
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuauugaacgcagcaaagccuacagcaacuguuacccuuaugaugugccggauuaugccucccuuaggucacuaguugccucauccggcacacuggaauuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacgggcaaugaccaaaucagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaggcauugaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30770 - RNA, 1701 nt, Artificial Sequence
  hemagglutinin__InfluenzaA__AAZ74584
augaagacuaucauugcuuugagcuacauuuuaugucuaguuuucgcucaaaaacuucccggaaaugacaacagcacggcaacgcugugccuggggcaccaugcagugccaaacggaacgcuagugaaaacaaucgcgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugcuucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacagaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguugcuuugcugggguucaucaugugggccugccaaaaaggcaacauuaggugcaacauuugcauuuga

SEQ ID NO: 30771 - RNA, 1701 nt, Artificial Sequence
  hemagglutinin__InfluenzaA__AAZ74595
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30772 - RNA, 1701 nt, Artificial Sequence
  hemagglutinin__InfluenzaA__AAZ74617
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccagaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcaaaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30773 - RNA, 1701 nt, Artificial Sequence; identical to SEQ ID NO: 30574
  hemagglutinin__InfluenzaA__AAZ79505

SEQ ID NO: 30774 - RNA, 1701 nt, Artificial Sequence
  hemagglutinin__InfluenzaA__AAZ79516
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguccaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguugucucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30775 - RNA, 1701 nt, Artificial Sequence
  hemagglutinin__InfluenzaA__AAZ79527
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucucuagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauuccgaaugcaucacuccaaauggaagcauucccaaugacaaaccauuucaaaauguaaacaggaucacauauggggccugucccagauauguuaagcaaaacacuuugaaauuggcaacagggaugcgaaauguaccagagagacaaacuagaggaauauuuggcgcaaucgcgggcuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagagauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30776 - RNA, 1698 nt, Artificial Sequence
  hemagglutinin__InfluenzaA__AAZ79549
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacugugccuacuaaaagggauagccccccuacaauuggguaauugcagcguugccggauggaucuuaggaaacccagaaugcgaauuacugauuuccaaggaaucaugguccuacauuguagaaacaccaaauccugagaauggagcauguuacccaggguauuucgccgacuaugaggagcuaagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaauccuaugcaaacaacaaagagaaagaaguccuuauacuaugggguguucaucacccgccuaacauagggaaccaaaggacccucuaucacacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccacgacuccaaugugaagaaucuguacgagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaauugauggagugaaauuggacucaaugggggucuaucagauucuggcgaucuacucaacugucgccaguucccugguucuuuuggucucccugggggcaaucagcuucuggauguguuccaauggguccuugcaguguagaauaugcaucuga

SEQ ID NO: 30777 - RNA, 1701 nt, Artificial Sequence
  hemagglutinin__InfluenzaA__AAZ79560
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaagucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30778 - RNA, 1701 nt, Artificial Sequence
  hemagglutinin__InfluenzaA__AAZ79571
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucguugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30779 - RNA, 1701 nt, Artificial Sequence
  hemagglutinin__InfluenzaA__AAZ79582
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30780 - RNA, 1698 nt, Artificial Sequence
  hemagglutinin__InfluenzaA__AAZ79604
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaaggaagcucauggcccaaccacaccguaaccggaguaucagcaucaugcucccauaaugggaaaagcaguuuuuacagaaauuugcuauggcugacggggaagaaugguuuguacccaaaucugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacaggauuacaaacaaggugaauucuguaauugagaaaaugaacacucaauucacagcugugggcaaagaauucaacaaauuagaaagaaggauggaaaacuuaaauaaaaagguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccgaaauauuccgaagaaucaaaguuaaacagggagaaaauugauggaguaaaauuggaaucaaugggagucuaucagauucuggcgaucuacucaacugucgcuaguucccugguucuuuuggucucccugggggcaaucagcuucuggauguguuccaaugggucuuugcaguguagaauaugcaucuga

SEQ ID NO: 30781 - RNA, 1701 nt, Artificial Sequence
  hemagglutinin__InfluenzaA__AAZ79615
augaagacuaucauugcuuugagcuacauucuaugucugguuuucgcucaaaaaauucccggaaaugacaacagcacggcaacgcugugcguugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaauuagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 30782 - RNA, 1701 nt, Artificial Sequence
  hemagglutinin__InfluenzaA__AAZ79627
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaaagugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30783 - RNA, 1701 nt, Artificial Sequence
  hemagglutinin__InfluenzaA__AAZ79941
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaauuagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 30784 - RNA, 1701 nt, Artificial Sequence
  hemagglutinin__InfluenzaA__AAZ79944
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuauugaacgcagcaaagccuacagcaacuguuacccuuaugaugugccggauuaugccucccuuaggucacuaguugccucauccggcacacuggaauuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaguuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaggcauugaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30785 - RNA, 1701 nt, Artificial Sequence
  hemagglutinin__InfluenzaA__AAZ79963
augaagacuaucauugcuuugagcuacauucuaugucugguuuuugcucaaaaacuucccggaaaugacaacagcacggcaacgcugugccuugggcaccaugcaguaccaaacggaacgauagugaaaacaaucacgaaugaccaaauugaagucacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuagaucacuaguugccucauccggcacacuggaguuuaacaaugaaagcuucaauuggacuggagucacucaaaauggaacaagcucagcuugcaaaaggagaucuaauaacaguuucuuuaguagauugaauugguugacccacuuaaaauucaaauacccagcauugaacgugacuaugccaaacaaugaaaaauuugacaaacuguacauuugggggguucaccacccggguacggacaaugaccaaaucagccuauaugcucaagcaucaggaagaaucacagucucuaccaaaagaagccaacaaacuguaaucccgaguaucggaucuagacccaggauaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguggcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugaguugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30786 - RNA, 1701 nt, Artificial Sequence
  hemagglutinin__InfluenzaA__AAZ79974
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguucuucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacgaacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30787 - RNA, 1701 nt, Artificial Sequence
  hemagglutinin__InfluenzaA__AAZ79996
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuauugaacgcagcaaagccuacagcaacuguuacccuuaugaugugccggauuaugccucccuuaggucacuaguugccucauccggcacacuggaauuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucuaucagaaauggaacuuaugaccaugauguauacagagaugaggcauugaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30788 - RNA, 1701 nt, Artificial Sequence
  hemagglutinin__InfluenzaA__AAZ80007
augaagaccauuauugcuuugagccacauuuucugucugguucucggccaauaccuuccaggaaaugacaacagcacagcaacgcugugucugggacaucaugcagugccaaacggaacacuagugaaaacaaucacaaaugaucagauugaagugacuaaugcuacugagcuaguucagagcuccucaacggggaaaauaugcaacaauccucaucgaauccuugauggaauagacugcacacugauagaugcucuauugggggacccucauugugaugguuuucaaaaugagacaugggaccuuuucguugaacgcagcaaagcuuucagcaacuguuaccccuaugaugugccagauuaugccucccuuagaucacuaguugccucgucaggcacucuugaguuuaucacugaggguuucacuuggacuggggucacucagaaugggggaagcaaugcuugcaaaaggggaccugguagcgguuuuuucaguagacugaacugguugaccaaaucagaaagcacauauccagugcugaacgugacuaugccaaacaaugacaauuuugacaaacuauacauuuggggaguucaccacccgagcacgaaccaagaacaaaccagccuguauguucaagcaucagggagagucacagucucuaccaggagaagccagcaaacuauaaucccgaauaucgggucuagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaacgacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaucaaaucaaugggaaauugaauaggguaauugagaagacaaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaucugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucauguuuuuugcuuuguguuguuuugcugggguucaucaugugggccugccagagaggcaacauuaggugcaacauuugcauuuga

SEQ ID NO: 30789 - RNA, 1701 nt, Artificial Sequence
  hemagglutinin__InfluenzaA__AAZ80017
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugggauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaauuagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 30790 - RNA, 1701 nt, Artificial Sequence
  hemagglutinin__InfluenzaA__AAZ80030
augaagacuaucauugcuuugagcuacauucuaugucugguuuucgcucaagaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaccagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuuuaggcaucaaaauucugagggaauaggacaagcagcagaucucaaaagcacucaagcagcaaucaaccaaaucaaugggaagcugaauagguugaucggaaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguucgaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30791 - RNA, 1701 nt, Artificial Sequence
  hemagglutinin__InfluenzaA__AAZ83242
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucaaauccuugauggagaaaacugcacacuaauagaugcucuauugggagacccucagugugauggcuuccaaaauaagaaaugggaccuuuuuguugaacgcaacaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaucacccggguacggacagugaccaaaucaaccuauaugcucaagcaucaggaagaaucacaguuucuaccaaaagaagccaacaaacuguaaucccgaauaucggauauagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacccugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgaaaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30792 - RNA, 1701 nt, Artificial Sequence
  hemagglutinin__InfluenzaA__AAZ83266
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuaaugagcugguucagaguuccucaacagguagaauaugcgacaguccucaccaaauccuugauggagaaaacugcacacuaauagaugcucuauugggagacccucguugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30793 - RNA, 1701 nt, Artificial Sequence
  hemagglutinin__InfluenzaA__AAZ83277
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccccgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30794 - RNA, 1701 nt, Artificial Sequence
  hemagglutinin__InfluenzaA__AAZ83288
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggaaggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30795 - RNA, 1701 nt, Artificial Sequence
  hemagglutinin__InfluenzaA__AAZ83312
augaagacuaucauugcuuugagcuacauuuuaugucugguuuucgcucaaaaacuuccuggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacugauagaugcucuauugggagacccccauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggaguugcucagaauggaacaagcucugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaucacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaauaaggucagaugcacccauuggcaaaugcaauucugaaugcaucacuccaaauggaagcauucccaaugacaaaccauuucaaaauguaaacaggauaacauauggggccugucccagauauguuaagcaaaacacucugaaauuggcaacagggaugcggaauguaccagagaaacaaacuagaggcaucuucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30796 - RNA, 1701 nt, Artificial Sequence
  hemagglutinin__InfluenzaA__AAZ83323
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugcaggauuaugccucccuuaggucacuaguugccucauccggcacccuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucucgaauaucggaucuagacccuggguaaggggugucuccagcagaauaagcaucuauuggacaauaguaaaaccgggagacauacuuuugauuaccagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30797 - RNA, 1701 nt, Artificial Sequence
  hemagglutinin__InfluenzaA__AAZ83371
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacgaacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuagcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacaccaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30798 - RNA, 1701 nt, Artificial Sequence; identical to SEQ ID NO: 30764
  hemagglutinin__InfluenzaA__AAZ83688

SEQ ID NO: 30799 - RNA, 1698 nt, Artificial Sequence
  hemagglutinin__InfluenzaA__ABA06510
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacugugccuacuaaaaggaauagccccccuacaauuggguaauugcagcguugccggauggaucuuaggaaacccagaaugcgaauuacugauugccaaggaaucaugguccuacauuguagaaacaccaaauccugagaauggagcauguuacccaggguauuucgccgacuaugaggagcuaagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuauacuaugggguguucaucacccgccuaacauaggggaccaaaggacccucuaucacacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccacgacuccaaugugaagaaucuguacgagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaauugauggagugaaauuggacucaaugggggucuaucagauucuggcgaucuacucaacugucgccaguucccugguucuuuuggucucccugggggcaaucagcuucuggauguguuccaaugggucuuugcaguguagaauaugcaucuga

SEQ ID NO: 30800 - RNA, 1698 nt, Artificial Sequence
  hemagglutinin__InfluenzaA__ABA08464
augaaagcaaaacuacugguccuguuauguacauuuacagcuacauacgcagacacaauauguauaggcuaccaugccaacaacucaacagacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccguaaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacgaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 30801 - RNA, 1698 nt, Artificial Sequence
  hemagglutinin__InfluenzaA__ABA08486
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgauuaugaggaacugagggagcaauugaguucaguaucuucauuugagagauucgaaauauuccccaaaggaagcucauggcccaaccacaccguaaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaccacccaccuaacauaggggaccaaagggcccucuaccauacagaaaaugcuuaugucucuguagugucuucacauuauaguagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucugguuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 30802 - RNA, 1698 nt, Artificial Sequence
  hemagglutinin__InfluenzaA__ABA08508
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacugugccuacuaaaaggaauagccccccuacaauuggguaauugcagcguugccggauggaucuuaggaaacccagaaugcgaauuacugauuuccaaggaaucaugguccuacauuguagaaacaccaaauccugagaauggagcauguuacccaggguauuucgccgacuaugaggagcuaagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaaaagaaagaaguccucauacuaugggguguucaucacccgccuaacauagggguccaaaggacccucuauuacacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccacgacuccaaugugaagaaucuguacgagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaauugauggagugaaauuggacucaaugggggucuaucagauucuggcgaucuacucaacugucgccaguucccugguucuuuuggucucccugggggcaaucagcuucuggauguguuccaaugggucuuugcaguguagaauaugcaucuga

SEQ ID NO: 30803 - RNA, 1698 nt, Artificial Sequence
  hemagglutinin__InfluenzaA__ABA12707
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaucacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagagagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 30804 - RNA, 1698 nt, Artificial Sequence
  hemagglutinin__InfluenzaA__ABA12715
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaaggaagcucauggcccaaccacaccguaaccggaguaucagcaucaugcucccauaaugggaaaagcaguuuuuacagaaauuugcuauggcugacggggaagaaugguuuguacccaaaucugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggaguacaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaagugugacaaugaaugcauggaaagugugaaaaauggaacuuaugacuauccgaaauauuccgaagaaucaaaguuaaacagggagaaaauugauggaguaaaauuggaaucaaugggagucuaucagauucuggcgaucuacucaacugucgcuaguucccugguuuuuuuggucucccugggggcaaucagcuucuggauguguuccaaugggucuuugcaguguagaauaugcaucuga
